United States Patent 8,871,488 (RECOMBINANT HOST CELLS COMPRISING PHOSPHOKETOLASES) - sequence listing, part 2

SEQ ID NO: 1490 - DNA, 2115 bp, Pseudomonas aeruginosa UCBPP-PA14
atgcataccttcttcatcgccccgaccggtttcggcgtcggcctcacctcgatcagcctcggcctgcttcgcgccctggaacgcgccgggctgaaggttggcttcttcaaacccatcgcccagctgcatcccggcgacctcggcccggagcgctccagcgaactggtggcgcgcacccacggcctggatacgccgaagccgctgccgctggcccaggtcgagcggatgctcggcgacggccaactggacgaactgctcgaagagatcatcagcctctaccagcgcgccgccgccgacaaggacgtggtgatcgtcgaaggcatggtaccgacccgtcacgccagctacgccgcgcgggtcaacttccacctggcgaagagtctcgacgccgaggtgatcctggtctccgcgccggaaaacgagacgctcaccgaactgaccgaccgtatcgagatccaggcccagctgttcggcggcccgcgcgacccgaaggtgctcggggtgatcctcaacaaggtccgcggcgaggccgacgcggccaacgccgaggacggcgtggcggacttcgcccggcgcctcaccgaacactcgccgctgctgcgcgacgacttccgcctgatcggctgcattccctggcaggacgaactcaacgccgcgcgcacccgcgacatcgccgatctgctcagcgcacgggtgatcaacgccggcgactacgagcagcgccgggtgcagaagatcgtgctatgcgcccgcgccgtgcccaacaccgtgcaactgctcaagcccggcgtgctggtggtgacccccggcgaccgcgacgacatcatcctcgccgccagcctggccgcgatgaacggcgtacccttggccggcctgctgctgtgcagcgacttcccgcccgacccgcggatcatggaactctgccgcggcgccttgcagggaggcctgccagtgctgtcggtggccaccggctcctacgacaccgcgaccaacctgaaccggatgaacaaggaaatcccggtggacgaccgcgagcgcgccgagcgggtcaccgagttcgtcgccgggcacatcgatttcgaatggctcaagcagcgctgcggtacgccgcgcgagctgcgcctgtcgccgccggcgttccgctaccaggtggtgcaacgcgcgcagaaggccggcaagcgcatcgtcctgcccgagggcagcgagccgcgcaccgtgcaggcggcggcgatctgccaggcgcgcggcatcgcccgctgcgtgctgctggccaagccggacgaggtccaggcggtggcccaggcccagggcatcgtgctaccggaaggcctggagatcatcgacccggacctggtgcggcagcgctacgtcgaaccgatggtcgagctgcgcaagggcaaggggctgaacgcgccgatggcggagcagcaactggaggacagcgtggtcctggcgaccatgatgcttgccctggacgaggtcgacggcctggtctccggcgccatccacaccaccgccagcaccatccgcccggcgctgcaactgatcaagaccgcgcccggctacaacctggtgtcgtcagtgtttttcatgttgttaccggaccaggtgctggtctacggcgattgcgcggtgaatcccgatccttcggccagtgacctggccgagatcgccgtgcagagtgccgcgtcggcgcaggctttcggcatcccggcacgggtcgcgatgatcagctactccaccggcgactccggttccggggtggatgtcgacaaggttcgcgaggccacccgcctggcgcgcgagcagcgccccgacctgttgatcgacggacccttgcagtatgatgccgccgccatcgccagcgtcggccgccagaaggcgccgaacagcccggtggccgggcaggccacggtgttcatcttccccgacctgaacaccggcaacaccacctacaaggcggtgcagcgcagcgccgattgcgtcagcgtcgggccgatgctgcaaggcctgcgcaaaccggtgaacgacctgtcgcgcggcgcgctggtggaagacatcgtctacaccatcgccctcaccgccatccaggcggacgcccaggccccggcctga

SEQ ID NO: 1491 - DNA, 2091 bp, Pseudomonas syringae pv. tomato str. DC3000
atgcagacgtttttcattgcccccacggattttggtgtggggttgacctccattagcctgggcctggtgcgcacgcttgagcgtgcgggcttgaaggtaggtttcttcaaaccgatagcgcaaccgcaccccggcgatctcggccctgaacgctcgaccgagctgatggcccgtactcacggcctgaaaccgcccaaaccgctgggtctggcgcacgtcgaacgcatgctgggcgatggccagctggacgaactgctcgaagaaatcatcaatctttatcagcaggcagccgtcggcaaggatgtgctggtggtcgaaggcatggtcccgacccgcagcgcgagctatgccgcacgggtcaacctgcacctggccaagagcctggacgccgaagtgatactggtttccgcgccggaaaacgaagtgctgaccgaactgtcgggaagggtcgagttacaggcgcagctgtttggcggccccaaggacccaaaagtattgggcgtcatcctcaataaagtgcgcaccgaagagagcatggaagtctttgctgcgcgccttaaagaacattcgccgctgctgcgcaacggcgatttccggctgttgggctgcattccctatcgcgccgaactcaatgcgccgcgtacccgtgatgtggccgagttgctgggcgctcaggtgctgaatgcgggcgactacgatcaacggcgcatgtcaagaatcatcatctgtgcgcgcacggtgctcaataccgtgccgctgctcaagcccggcgtattggtcgtaaccccgggcgaccgcgacgacatcatcctcgccgtgagcctggcagcgatcaatggagtaccgctggcaggcctgctgttgaccagcgataccgtgcccgacccgcgcatcatggaactgtgccggggcgcgcttcaggccggcctgccggtgctgtcggtgagcactggctcctatgacacggccaaccgcctcaatcagttgaacaaggaaatccccatcgatgaccgcgagcgcgcggaaatcatcaccgatttcgtcgccagtcatctggacgccagctggctgcaccagcgctgcggcaccccacgagagctgcgcctgtcacctgcggtgttccgctatcagttgattcagcgcgcccaggcggccaataaacgcatcgtgctacccgaaggcaacgaaccgctgaccattcaggccgcggcgatctgtcaggcgcgcggtatcgctcgctgtgtgttactggccaggcccgaagaggtgcaggcggttgcgcaggcacatggcatcgagctgccaccggggctggagattctcgacccggacctgattcgcgagcgctatgtcgcgccgatggtcgaactgcgcaagagcaaaagcctgaacgcgccgatggccgagcaacagcttgaagaccccgtagtgatcggcacggtgatgctggcactcgatgaggtagacgggctggtgtccggcgtggttcattccacggccaacaccatccgcccggccctgcaactgatcaagaccgcgccgggctgcacgctggtgtcgtcggtgtttttcatgctgtttcccgagcaggtgctgatgtatagcgactgcatcatgaatcctcacccaagcgccagcgaactgtccgagatcgccctgcaaagcgccgattcggccactgcgttcggcatctcgccccgcgtggcgatgattagttattccagcggcaattcggccagcggtgaagaagtcgagaaagttcgcgaggcaacgcaactggcacgcgaaacccgccgcgatctattgatcgacggaccgctgcagtatgatgccgccgccaacgaacacgtcgcccggcaactggccccggacagtcaggtggcaggacgcgccaatgtgttcgtgtttccagacctcaacactggcaacaccacgtacaaggcggtgcaacgcagcgccgactgtgtaagcttgggcccgatgctgcaaggcctgcgcaaaccggtgaacgacctgccacgtggcgcgcaggtcgatgacatcgtctacaccatcgcactgacggcgatacaggccgacacactttcctga

SEQ ID NO: 1492 - DNA, 2100 bp, Pseudomonas fluorescens Pf-5
atgcaaacttttttcatcgcgcccaccgattttggagtgggtctgacctccatcagcctcgggctggtgcgtacgctggaacgggctggcctcaaggtcggcttcttcaaacccatagcccaacctcaccccggtgacaccggccccgagcgttccaccgaactggtggcgcgcacccatggcctgaaaccgccacaacccctgggcctggcccatgtggagcggatgctcggcgacggccagctggatgagttgctggaagaaatcatcaccctctaccagcaggcggccatcggcaaggatgtattgatcgtcgaaggcatggtgccgacccgcagtgccagctacgccgcccgggtcaacctgcacctggcaaaaagcctggatgccgaggtgatcctagtatccgccccggaaaacgaagtgctcaccgagctgtccggacgggtcgagttgcaggcccagctgttcggcggcccgcgggacccgaaagtgctgggggtgatcctcaacaaggtgcgcaccgacgaaagcatggaggcgttttccgcgcgcttgaaggaacattcgcccttgctgcgcagcggcgacttccgcctgctgggctgcattcccttccaaccggaactgaacgcgccgcgcacccgtgacgtagcggacctgatgggcgcccaggtgctcaacgccggcgactacgaaagccggcgcatgaccaagatcatcatttgcgcccgcaccatgcgcaacaccgtggaactgctcaagcccggcgtgctggtggtgaccccgggcgaccgtgacgacatcatcctcgccgtgagcctggcggccatcaacggcgtgcccctggccggcctgctgctgaccagcgacaccctgcccgacccgcggatcatggagctctgccggggcgccctgaacgccggcctgccagtgctttcggtgagcaccgggtcctacgacaccgccaaccagctcaatggcctgaacaaggaaattcccatcgatgaccgcgagcgcgcggaaatcatcaccgacttcgtcgccagtcatctggacgccaactggctgcaccaacgctgcggcaccccgcgggaaatgcgcctgtcgccggcagtgttccgctatcagttgatccagcgggcacaggaagccaacaagcgtatcgtcctgcccgaaggcagcgagccgctgaccgtgcaggccgccgccatctgccaggcccggggcatcgcccgctgcgtgctgttggccaagcccgaggacgtgcacgcggtggcccgggcccagggcatcgaactgcccgaaggcctggagattctcgacccggacctgattcgccaacgctatgtggagcccatggtggccctgcgcaagagcaagagcctcaacgctcccatggccgagcagcagctggaagatccggtggtgatcggcacggtgatgctggccctggatgaagtcgatggcctggtttccggggtcatccactccactgccaacaccatccgcccggccctgcagttgatcaagaccgcgccgggctgcagcctggtgtcctcggtgttcttcatgctgttccccgaggaagtgctggtgtatggcgactgcgtgatgaacccgcaccccagcgccagcgagctggcggaaatcgccctgcagagcgccgactcggcagccgccttcggtatcaccccgcgcgtggcgatgatcagctactccagcggcgactcggccagcggcgaggaagtggagaaagttcgcgaagccaccctgctggcccacgaagcccagcgttcgctgctgatcgacgggccgttgcaatacgacgccgcggccaacgaaaacgtcgcccggcaactggcccctaacagccaggtcgcgggcaaggccacagtcttcgtgttccctgacctcaacaccggcaacaccacccacaaggcggtgcaacgcagcgccgattgcgtgagcctggggccgatgctgcaaggcctgcgcaagccggtgaacgacctgccccggggcgcccaggtggacgacatcgtctacaccatcgcccttaccgcgattcaagccgccaaccgacctatggatgtctaa

SEQ ID NO: 1493 - DNA, 2091 bp, Pseudomonas entomophila L48
atgcagacatttttcatcgcgccgaccgactttggtgtcggcctgacctccatcagcctgggcctggtccgcaccctggaacgcgccgggctcaaggtcggcttcttcaagccgatcgcccagccgcatcccggcgataccggcccggagcgctccagcgaactggtcgcccgcacccatggcatcaagccgcccaccccgctgagcctggcccatgtcgagcgcatgctcggcgacgggcaactggacgaactgctcgaagaaatcattcgcctctaccagcaagcctgcgtcggcaaagacgtggtggtggtggaaggcatggtgccgacccggcacgccagctacgcggcacgggtcaacctgcacctggccaagagcctggatgccgaggtgatcctggtatcagcgccggaaaacgaggtgctgagcgagctgtccggccgggtcgagctgcaggcccaactgttcggcggcccgcgcgacccgaaggtgctgggggtgatcctcaacaaggtgcgtaccgacgaaagcatggccgacttcgccacccgcctgcgcgagcattcaccgctgctgcgcggcaacgatttccgcctgctgggttgcatcccctaccaggccgacctcaacgccccgcgcacccgcgatgtcgccgagttgctcggtgcccaggtgctcaatgccggtgactatgagcagcggcgcatgaacaagatcatcatctgcgcccgtaccgtggccaacacggtaccgctgctgacctccggcacgctggtggtgaccccgggcgatcgcgacgacatcatcctcgcggtgagcctggcggcgatcaacggcgtgcccctggccggcctgctgctgaccagcgacagcaagcccgacccgcgcatcctcggcctgtgccgcggcgccttacaggccggcttgccgattctctccgtgagcaccggctcctacgacaccgccaaccagctcaattcgctgaaccgcgagatcccggtggatgaccgtgagcgcgccgaattcatcaccgacttcgtcgccagccacctggacgccgactggctgcatcagcgctgcggcacgccgcgtgagctgcgcctgtcgccagcggtgttccgttaccagttgatccagcgtgcccaacaggccaacaagcgcatcgtcctgcccgagggcgccgagccgttgctggtccaggccgccgcgctgtgccaggcccgcggcatagcccgctgcgtgctgctggccaagccggaggcggtggaagccgtcgcccgcgcccagggcatcaccctgccgcccgacctggaggtgctggacccggaactgattcgcggccgttatgtcgagcccatggtcgagttgcgcaagagcaagaacctcaacgcgccaatggccgaacagcaactcgaggatccggtggtgatcgccaccatgatgctcgccctgggcgaagtcgatggcctggtctcgggcctggtgcactccaccgccaacaccattcgcccggccctgcaactgatcaagaccgcgccgggctcaagcctggtctcatcggtgtttttcatgctgttccccgaccaggtgctggtgtatggcgactgcgtgatgaacccgcaccccagcgccgcggaactggccgaaatcgcccggcagagcgccgagtcggccgagtcgttcggcatcgcgccacgggtggcgatgctcagctactccagcgattcagcggccagtgacgaagaagtggaaaaagtgcgcgaagccacgcgcctggcccagcaggccgagcatgacctgctgatcgacgggccgctgcagtacgacgccgccgccaaccccgagatcgcccgccagctggcgccgtcgagcccggtggccgggcgcgccacggtgttcgtgttccccgacctgaacaccggcaataccacccacaaggcggtacagcgcagcgccgattgcgtcagccttgggccgatgctgcaggggctgcgcaagccggtcaacgacctgccgcgcggggcccaggtggacgatatcgtgcataccatcgcgttgacggcgattcaggccagcaccgtgcgctga

SEQ ID NO: 1494 - DNA, 2139 bp, Azotobacter vinelandii DJ
atgcacactctatttctcgcccccaccggctatgccgtcggcctcaactccatcagcctcggcctgatccgcgccctcgaacaggccggcctgaaggtcggcttcttcaagccgatcgcacaacccttccccatcgatcagggccgcgagcgctcctgtctgctggtcgagcgcaccctgggccggagcacgcccgagccgatactgctggatcaggtggagcgccatctggccagcggcgaaaccgacctgctgctggaggaagtggtcagccgctatcagcaggccgccgccggcaaggacgtggtgatcgtcgaaggcatgctgccgacccgcgacagcgactactccgcgtacctcaatcccctgctgagcaagagcctgaacgccgaagtcatcctgatcgccgtccagggcggcgatggcctcaagcaactggccgagcgtatcgagatccaggcccagttgttcggcggcatcaagagtccgaaggtgctcggcgcgatcatcaacaagatcgacagcggggacggcatcccggctttcgtcgagcgtctcaaggaatatctgccgtcgctcggcagcaccgacttccagctcttcggcgccattcccttcgccgaggaactgaatgccctgcgcacccgcgacgtggccgaactgatcggcgcccaggtgctcagcgccggcgaagccgaccggcgccgggtgagcaagatcgtgctgtgcgcccgtgccgtgcccagcaccgtgccgctgctgcagccgggcgtgctggtggtgacccccggcgatcgcgacgacgtcatcctcgccgccagtctggcctcgctcaacggcgtgaagctggccggcctgctgctgtgcagcgacttcatgccggacccgcggatcatggagctgtgcaaggcggccctggacggtggcctgccggtgatgagcgtgaccaccggctcctacgacacggccaccaacctgttcgccctgaacaaggaaacgccggcggacgatatcgagcgcgccacccgcgtcaccgatttcatcgccgggcatctgcatccggagtacctgcgttcgcgctgcagcctgccgcgcgagctgctcctgtcgccaccggcgtttcgctaccagttggtcaagagcgcccaggaagctgacaagcgcatcgtcctgccggaaggcaccgagccgcgaaccatccgcgccgccgccatctgccaagagcgcggcatcgcccgctgcgtgctgctggcccgcccggaagaggtccgggccgtggcgcgcgagcagggcatcactctgccggacggcctggaaatcctcgatccggagagcatccgcgcgcagtacatcgcgccgatggtgaagatgcgccagagcaagggcctcacccccgagatggccgacgagcagctcagggacaccgtggtgctcggcaccatgatgctggcgctggacgaggtggacggcctggtttccggcgccgtgcacaccaccgccaacaccattcgcccggccctgcaactgatcaagaccgcgccgggctacaacctggtgtcctcggtgttcttcatgctgctgccggaccaggtgctggtctatggcgactgcgcggtgaaccccaacccgagcgccgccgaactggccgagatcgccctgcagagcgccgagtccgcggtggccctcggcgtgcacccgcgcgtggcgatgatcagctattccaccggcgattccggcagcggcgccgaagtggacaaggttcgcgaggccacccgcatcgcccaggagcgggcgcccggcctgccgatcgacggcccgctgcagtacgacgccgcctccgtggccagcgtcggcaagcagaaggcgccgaacagcccggtcgccggccaggccaccgtgttcgtgttccccgacctgaacaccggcaacaccacctacaaggcagtgcaacgcaacgccaactgcatcagtgtcggcccgatgctgcaggggctggccaagccggtgaacgacctgtcgcgcggcgccctggtcgacgacatcgtcttcaccatcgccctcaccgcgcttcaggcggccagcatcgacaagcaggagaagcagaaggcgctggagcaggggcagccggtcggagcctga

SEQ ID NO: 1495 - DNA, 2097 bp, Pseudomonas stutzeri A1501
atgcacacactcttccttgcccctaccggtttcggcggcggcctcaattccatcagcctcggcctgatccgcgcgctggaaagcgccgggctgaaggtcggtttcttcaagccgatcgcccaacccttcccggtcgaccagggccgcgagcgctcctgcatcctcgtcgagcgcacgctgaacctgacctctcccgaaccgctgccgctggaacaggtggagcgccagctcgccgatggcgagatcgacctgttgctcgaggacgtggtcagccgcttccagcaagtcgctgtgggcaaggacgtggtcatcgtcgaaggcatggtgccgacccgcgagtccaactacacccaacgcatcaacacccagctcgccaagagcctggacgccgaggtcatcctcatcgcggcccagggcagcgacagcctcaagcgtctggccgaacgcatcgagatccaggcccagctgtacggcggcgccaaggatccgaaagtgctcggcgtgatcctcaacaaggtcaagaccgaggaaggcctgccggctttcgtcgacagcctcaagcagcacctgccgctgctgggcagcgccgacttccagctgctcggcgccatcccgttctccgaggaactcaacgccctgcgcacccgtgacatcgccgaactgctcggcgcccaggtgctcaacgccggcgaggccgaccagcgccgcgtgaacaagatcgtgctctgcgcccgcgccgtgccgaacaccgtgcaactgctgcgctccggcgtgctggtggtgaccccgggcgaccgcgacgacatcatcctcgccgccagcctggcctcgctcaatggcgagaagctcgccggactgctgctgtgcagcgacttcgcgccggacccgcgcatcctcgagctgtgcaaggccgcgctggacggcggcctgccggtgatgaccgttgagaccaactcctacgacacggccaacaacctgttcggcctgaacaaggaaaccccggcggacgacatcgaacgcgccacccgcgtgaccgacttcatcgccaagcacctgcaccccgaatttctccacacccgctgcagcgtgccgcgtggcgagctgcgcatgtcgccggcggcgttccgctatcagctggtcaagcgcgcgcaggacgccaacaagcgcatcgttctgccggaaggcaacgagccgcgcaccatccgcgccgccgccatctgccaggagcgcggcatcgctcgctgcgtgctgctggccaagccggaggaagtccagcaggtcgcccgcgagcagggcatcaccctgccggccagcctggaaatcctcgatccggacagcatcgccaaccgctacgtcgagccgatgtgcgagatgcgcaaggccaagggcctgacgcccgacgatgcccgcgagcagctgaaggacaccgtggtcctcggcaccatgatgctggcgctggacgaagtggacggcctggtttccggtgccgtgcataccaccgccaacaccattcgcccggccctgcagctgatcaagaccgcgccgggctacagcctggtgtcttcggtgttcttcatgctgctgccggatcaggtgctggtctatggcgactgcgcggtgaacccgaacccgagcgccaccgaactggccgagatcgctctgcagagcgccgagtccgccgtggcgctgggcgtcaatccgcgcgtggcgatgatcagctactctaccggcagctccggcagcggtgcggaagtcgagaaagtcgccgaagccacccgcatcgctcaggagcgtgcaccggacctgccgatcgacggccccctgcagtacgacgccgcttccgtgctcagcgtcggccggcagaaggcgccaaacagcaaggtggccggccaggccacggtgttcatcttccccgacctgaacaccggtaacaccacctacaaggccgttcagcgcaacgccaactgcctcagcgtcggtccgatgctgcaaggcctcgccaagccggtgaacgacctgtcccgcggtgccctggtggacgacatcgtcttcaccatcgccctcaccgccttgcaggccgccaaccagaagggctga

SEQ ID NO: 1496 - DNA, 2088 bp, Nitrosomonas europaea ATCC 19718
atgcatactttctttgttacctctaccggctttggtgtcggactcacttcaaccagtttaggattggtgcgggcgctcgaatatggcggccttaaagcgggtttttataaacctgtcgctcagcaacatcccggtaattccaagcttgaatattccactgaactgatctcgcgaacgttgggcctggcaccacccgctccgcttccgttagctacagttgaacatctgctgggtgaaggtcagattgacgacttgatggaagatatcgtccggcgatttaagcaagcctctgaaggttatgatgtgatggtggtagaaggtatggtacctacacgccatgtcagctatgcctcacgcgtgaataccaggctggccagcagccttgatgctgatatcatcctcgtttcatctgccgaagatgatgcactgcaggcaattacagatcgtattgaaattcaggctcaattttttggtggtgctcagaatcctcgtctattgggcgtaatcctcaataaaattcgcaccgatcattctgatgatctttttgaacagctaaaaaaccattccaccctgttccatcaatccagctttcagattctgggttgtattccctgggaggattccttgaatgctcctcgcatggcagacgttgtcacacagctgcaagctcagatcgtaaacgcgggggatagtgaaaaacgccgtgtacaggatatcgtgctgtttgccagtgccgcccccaattcagtgacattgttacgtcccggagttctggtggtaacacctggtgaccgggacgatattgtcatggccgccagccttgccgtactgaatggtgtaccactggcggggttactgctgtgcagtgattttccgccagatccgcgcgtgctggaattgtgcaaaggtgcactgacaaaaggattaccagtttgtaccgtcacgaccaattcatacgataccgccgccaacctgcatcgcatgaatcgggagattccgctggatgaccacgagcgtgctgagcgcatcaccaactttgtggcgaatcatattcgtcaggaattattggttaagcgctgtggtgagccacaggaacaacgcctttctccccccgccttccgctatcgcctggtcaagcgggcgcaagaggctgattgccgtatcgtgttaccggaagggtacgaaccccgcaccatacaagcggcaaccatttgccaggaacgtggcattgcccgttgcgtgttgctggcaaaacctgatgcagtaaaagcggtggccagcgcacgtggcattaccctgcccgaagggcttgaaatgattgatccggaaaaagtgcgccgaaattatgtggcggctatggtggagttacgcaagcacaaaggattaaatgaacccatggcgctggcgcaactggaggacaatgtcgtgctgggcaccatgatgctggcgacgggtgaagtcgatggcctcgtctccggcgcaatcaataccaccgccaataccattcgccccgctttgcaactgatcaaaacagcaccgggttttaaacttgtctcctctgtcttctttatgctgctgccagaacaagtcgtcgtgtatggagattgtgcggtcaatcctaatcctacggctgaagaactggccgatatcgcactgcaaagtgccgcgtcggcacaggcactgggtatcgagccacgcgtagccatgttgagttattccaccggtgattccggcagcgggcaagaagtggaaaaagtacgcgaagccactcgacttgcccgtttggcacgtcccgatctgctgatcgacggccctctgcaatacgatgccgctgcgattgccagcgtgggccggcaaaaagcacctggcagcccggtagcagggcgcgctaccgtgtttatctttccggatctcaacaccggcaataccacttacaaagccgtacagcgcagcgccaacgtagtcagtgtcggccccatgttgcaaggcctgcgtaagccggtgaatgatctgtcacgcggcgcatcggtggaagatattgtttataccattgccttgactgccgtacaggcggccagtcaacgctaa

SEQ ID NO: 1497 - DNA, 2076 bp, Azotobacter vinelandii DJ
atgcagaccttcctgatcgcccccagcagctacggcgtcggcctcacctcgatcagcctcggtctggtccgcgccctggagcgctacggactgaaagtcggcttcttcaagccggtcgcccagccgcaccccggcgattgcggcccggagcgcaccagcgcactgatcgcccgcacccaccacctcgatccgccggaacccctgcccctggcccgagtggagcggcgcctcggcgacggccagttgaacgagctgctggaggacatcgtcggccgcctgcaacagttggaaaacggccacgacgtgctgatcgtcgagggtctggtgccgagcccgcaggtcggctatgccgcgcgcctcaacggacatctggcgcgcagcctgaacgccgacgtcatcctggtctccacgccggccgaggaaagcctcgaggaactgcgcgaccacctggagatccaggcccgtctgctcggcgccggccaggacacgccggtcgctggggcgatcctcaacaaggtgcctccgggaccgctggccgagcgcctgtgccagccggaaccgctgggccggaacctgcgcctgctcggctgcgtgccctggcgcgacacgctgaacaccccgcgcaccagcgacatcgccgacctgctcggcgcgcgcctgctcaaccccggcgactaccgccagcgccgggtgcagcacagcctgctgtgcgccgccgccgcgccgagcctgctgccgcgcttcaagccgggcaccctgctgctggcgcccggcgaccgccatgacgtgatcctcgccgccggcctggccagccgcaacggcatgtcgctggccggcctgctgctgtgcggcgccctgcccgccgacgaacgggtgctcgaactgtgccggccggccatggccgacggcctgccggtgctcgccgtggagcgcgatcccgaggacaccctgcgcgaactggagcggctgaaccgggaaatccccctcgacgatctggaacgcgccgagcggatcagcgactacgtggccagtcacctggaccgcgcctggttcatccagcgctgcggcacgccccgcgagccacgcctgtcgccgccggcgttccgctacaacctggtaaagcgggcccaggcggcgaaccggcgcatcgtcctgccggaaggcagcgaaccgcgcaccgtgcaggccgcggcgatctgccagcggcgcggcatcgcccgctgcgtgctgctggccaggcccgaggaggtgcaggcggtggcccgcgcgcagggtatcgagctgcccgccggcctggagatcgtcgatcccgagcagatccgcgagcgctatgtcgagcccatggtcgagctgcgccggcacaagggcctgagcgccccggcggcacgcgcccaactggaggacaacgtggtgctcggcaccctgatgctggccctggacgaggtcgacggcctggtctccggcgccgtgcacaccaccgccaacaccatccgcccggcgctgcaactgatcaagaccgcgccgggctgcaagctggtttcctcggtgttcttcatgctgctgccggagcaggtgctggtctacggcgactgcgcggtgaatcccgacccgagcgccgaggaactggccgacatcgccttgcagagcgccgcctcggcgcaggccttcggcattccgccgcgggtggcgatgatcagctattccaccggcgcctccggcgaaggggcggacgtcgagaaggtccgcgaggccacccgactggcccgccaggcccgtcccgacctgccgatcgacggtccgttgcagtacgacgccgcggcgatcgccgaagtcgcccggcagaaggctccggacagcacggtggccggccgcgccacggtgttcgtgttccccgacctgaacaccggcaacaccacctacaaggcggtgcagcgcagcgccaactgcgtcagcgtcggccccatgctgcagggcctgcgcaagccggtgaacgacctctcccgcggcgcgctggtcgacgacatcgtcttcaccatcgccctcaccgcgatccaggccgaaaccgccgccggctga

SEQ ID NO: 1498 - DNA, 2118 bp, Deinococcus deserti VCD115
atgaaaaccctttttgtcgcgcccacccgcaacggcgtgggtctgtccagcacagcgctgggattgatgcgtgccctggagcgccagggcctcaaggtggccttcctcaagcccatcgcccagacccacgaggccgacactgatgacagcgtccatttcgcgcgcgtgctggctcatgcggtgacgcctgaacctattcctctggcagtcgccgaagagcagctcagcctcggcggcagcgaggaactgatggaaaacgtcatcgccctcgctcgggaagccagtttgaccgggccagacggagtggccacggatgtcctgatcgccgagggtctggccctgaacgagcgcaatctgtacgccggcgccctcaacgccagtctggcgcgcaacctggaggccgagacggtgctggtgtcgagcctctcggaagtgacaccgggggtcctggccgacgaactggaaattgccgcgcagtcctaccgccgcagcgatggaagcgggctggcgggttacgtcctaaatttcgcgcccaccgagctggatttcggcagcctgatggctgagctgcgtgcccgcagccgggtgctggccagcggtgaactgccgctgctgggtgtggtgtcggtctcccctggtctggctgcgccgcgcacgctggacgtcgcccgctatctgggagccgaggtaatcaatgagggcgaagcccgcctccgccgtgtcaccagcacggtggtcactgccaggaccgtacccaagatggccagcttatttacacccggcgccctggtggtcacgcccggtgaccgggaagatgtggtgatggccgcttcactggcgcacctcagtggcgtacccctggcaggattgatgttcacctccggtagcgctcctgaagacagcattgagcggctgtgccgcgcggcgctgagcagcaacctgccggtgctgcgggtggccaccaactcgtttcacacggcttcgaatctctcacgcatggacccgcgcgtacctcacgacgacaccgagcgcatggaccgcatgctggagtttattgctgaccggctcgacactgttccactgggcacacggctgcgcacgccgcaagaaggccgcgaacgccggctgccgcccagtgccttccgctacgaactgattcagaaggcccgcgcagcaaacaagcgcatcgtgctgccagagggcgacgagccacggaccgtgagggcagccatccgctgcattgaaaaaggtattgcccgctgcgtgctgctggccaaacccgacagggtgcggcaggtggccgagggccagggcctgagcctgcccgagggcctggaagtgctggaccccgacagcatccgggggcggtacgtggaacccatggttgaactgcggcgccacaagggcctgactgccccccaggctgaagcacagctggaagacacggtggtactgggcaccatgatgctggcgctggacgaggtagacggactggtatccggtgcggtgcacaccaccgccaacaccgtgcgcccggcgcttcagctgatcaagaccgcgcccggcgcgcagctggtcagcagcatctttttcatgctgatgcccgagcaggtgctggtgtacggcgacgccgccatcaatcccaaccccaacgcccaggaactggccgacattgccctgcaaagtgccgaaagtgcccgggccttcgggattccggtgcgggtggccatgctgtcctacagcaccggcgagagcggcagcggcgaggacgtggagaaggtcaaggaggccacccggctggtgcgcgagcggcacccggacattctggtggacggtcctcttcagtacgacgcggcgtcggtgctgaacgtgggccagcagaaagcaccgaattccccggtggccggacgggccacggtatttatcttcccggacctgaacaccgggaacaccacctacaaggccgtgcagcgcagcgccggggtggtggcagtggggcccatgctgcagggactgcgcaagccggtcaacgacctgtcgcgcggcgcgttggtcgatgacatcgtgttcacgatcgccctgacggccattcaggcaacgcaggggcgcgatgcttaa

SEQ ID NO: 1499 - DNA, 2112 bp, Deinococcus geothermalis DSM 11300
atgaaaaccctcttcatcgcccccacccgcaacggcgtgggcctgaccagcacggcgctgggactgctgcgcgcgctggagcgccaaggcctcaaagtcgcctttctcaagcccattgcccagacgcacgaggccgcacccgacgactcggtgcattgggcgcgcacgctcgcgcacgcggtcacacctgaccccatcctgctgtcggtggcggaagaacagctcagccaggggcaggaagaggaactgatggagaacgtggtcgccctggcccgggaggccgcagcaggcgtgaccggcggcgcggatgtgctggtggtagagggcctggcgctcaatgagcgcaacgtgtatgccgggccactgaatgccagcctggcccgcaacctggaagcggacgtggtgctggtgagcagtctggccggggtcacgcccgccacgctggccgacgagttggagatcgccgcgcaagcgtaccgccgctcggacggctcaggtctggcgggctacgtgctgaacttcgcgccgctggaactggatttcggagggctgctggccgatctgcgggcgcgcagccgcattctggccagcggggagctcccgctgctgggcgtgatcgcgcagtcgcccacgctggccgctccccgcaccctagacgtcgcccggcacctcggagccgaggtgctcaacgagggcgaggcccggttgcgccgcgtcacaagcacagtggtcacggcgcgcagcgtgcccaagatggctgaccttttcacctctggcgcgctggtcgtgacgccgggagaccgcgaggacgtggtgatggcggcggcgctctcgcacctcagcggggtgccgttggcgggcctcctgttcacgtcgggaagcacgcccgaagcggccattgagcggctgtgccgggccgccctcaccagcacgctgccggtgctgcgcgtggagacaaactcctacaacaccgcctcgcgtctctcgcgcatggaggcccgcgtcccccacgatgacctggaacgcatggagcgcaccctcgacttcatcgcggaccggctggacactgtgccgctgggcacccggctgcgcgcccccgaaggaagcgaacgccgcctgccccccagcgctttccgctacgaactgattcaaaaggcccgcgcggccaacaagcgcatcgtcctgccagaaggcgacgaaccgcgcaccgtgcgcgctgcgatccgctgtgtggaaaagggcatcgcgcgctgcgttctgcttgcccagcccgaaaaggtgcggcaggtcgcggaaggacagggcctcaccctgccggacggcctggagatcatcgacccagaccgcgtgcgggccaactacgtcgcgccgatggtggagctgcgcaaacacaaggggctgactgccccacaggccgaggcgcagctcgaggacaatgtggtgttggggacgatgatgctggctctggatgaggtggacgggctggtgtcgggcgccgtgcacaccaccgcgaacacggtgcggcccgccctacaactgatcaagacggcccccggcgtacggctcgtttcctcgatcttctttatgctgatgcccgagcaggtggtggtgtacggcgacgcagcgatcaaccccaatcccaacgcggaggaactcgccgatatcgccattcagtcggccgacagcgcccgcgcctttggcattccgccccgcatcgccatgctgagctactccaccggcgagagcggcgcgggcgccgacgtggaaaaggtgcggattgccaccaggctggtccgcgagcgccgccctgacctcccagtggacggtccgctgcaatacgacgccgcctcggtcctcagcgtgggccgccagaaggccccgaacagcccggtcgcgggccgcgccaccgtctttatcttccctgacctcaacaccggcaataccacctacaaggccgtgcagcgcgcggcgggcgtggtggcggtcggaccgatgctccaggggctacgcaaacccgtaaatgacctctcgcgtggagcgctggtcgacgacatcgtgtacacgattgcgctgacggcgattcaggccacgcaggcaagggaaggagcgtga

SEQ ID NO: 1500 - DNA, 2169 bp, Deinococcus radiodurans R1
ttggcaggccccatcccctttttcctgcccctgtctccccccgttcccaaggagtcccgcatgaaaaccctgtttctcgcacccacccgcaacggtgtggggctgtcgagcacggcgctcggcctcgcccgcgccctggagcgccagagcctgaaagtcgcctttctcaagccgattgcccagacgtatgaaccgcgcaccgacgacagcgtgcactttgcccgcgcggtggcgcacctgaccacgcccgacccgattccactgacccgcgccgaggagctgctcagtcagggtggcgaggaagacctgatggagcaggtgattgccctggcgcgcgaggcggcgggcgagggcagcgacgtgctgattgccgaggggctggcactcaacgagcgcaacgtgtacgcgggcaccctcaacgcccggctcgcccgcaacctggaggccgacaccgtgctggtgagcagcctcgccggggtcacgcccgccgaactcgccgatgaactggaaatcgccgcacagggctaccgccgcagcgacggctcggggctggcgggtttcgtgctcaacttcgcgccgcgtgagctggatttcggctcgctgatggccgagttgcgctcgcgcagccgggtgctggcttcgggcgaactgccgctgctcggcgtggtgtcgctcgacccggcgctgcgacaactgcgcacgctcgacgtggcccgcgctctggacgccgaaatcatcaacgcgggcgaggccgaaagccggcgcgtgagcagcacggtggtcactgcccgcagtgtgccgcagatgaccaacctctttacctccggggcgctcatcgtgacccccgccgaccgcgaggacgtgattatggcggcggcgctctcgcatctcagcggcacaccgctcgccgggctgatgtacacctccggcagcgcgcccgaggccaccattcagcaactctgcgaggtggcgctgacgagcagcctgccggtgttgcgggtgcccaccaactccttcgagacggcctcgcgcctcgtgcacctcgatttccgtgtgccgcacgatgacccgcgccgcatggaccggatgctcgactacatcgccgaccgcctcgacaccgtgccgctcggtgcccgactgcgcgctcccggtgtggcaggcgagcgccggctgcccccaagcgcctttcgctacgaactcattcagcgcgcgcgggcggcgaataaacgcatcgtgctgcccgagggcgacgagccgcgcaccgtcaaggccgccatccgctgcaccgaaaaagggattgcccgctgcgtgctgctcgccccacccgagaaagtgcggcaggtggcgcaggggcagggcctcgaactgcccgagggcctggaaatcatcgaccccgaaacggtgcgcggcaagtacgtcgccccgatggtggaactccgcaagagcaaggggctgactgagccgcaggccgaggcgcaactcgaagacagcgtggtgctcggcaccatgatgctggcgctcggcgaggtggacggactggtgtccggcgcggtgcacaccaccgccagcacggtgcgcccggcgctgcaactcatcaagacggcgcccggcagctcactggtcagctcggtgtttttcatgctgatgcccgagcaggtgctcgtctacggcgacgcggccatcaaccccgaccccaacgcgcaggaactcgccgacatcgccattcagtcggcagacagcgcccacgccttcgggattccggtgcgggtggcgatgctcagttattccactggcgaatcgggcagcggcgaggacgtggaaaaggtcaaggaagccaccaaactggtccgcgagcgccgtcccgagttgctggtggacggcccgctgcaatacgacgccgccagcgtgccgagcgtgggccgctccaaagcccccgacagcccggtggcggggcgcgccacggtcttcatcttccccgacctcaacaccggcaacaccacctacaaggccgtgcagcgcagcgcgggcgtggtcgccgtggggccgatgcttcagggcctgcgcaagccggtcaacgacctctcgcgcggggcgctggtggacgacatcgtgtacaccatcgccctcacggctattcaggcgacccagagcgcggcggattgcggttga

SEQ ID NO: 1501 - DNA, 2052 bp, Rhodoferax ferrireducens T118
atgcgtacgtatttcctggcgccgacacaacctaacgtcggcctgacctcggtttcactcggtctcttgcgggcgctgcagcggcgcggactgaaagtggcgtttgtcaagccgatcaccaagcgcacggccgacaccgaaccttcggtcctgttcgcacgcagcatctgtcatcttcagaacacgcccgaccccttgcccatgagtctggtgacacaacgcgtcagcagcggccagacggatgagctgcttgaagagatagtcagccttgccatgtcctgcaccaaggaggccgatgtgctgctggtcgaaggtattcatgcggatccgagcaggatattcattccgcgcctgtcgggtcagatcgcccgaagcctgcaggccgatgtggtcctggtggccagcgccgcggacgcgcagggcatcgccgagaccaactacctgattgcccagatccgcaatgtcggtcgcaacgtggtgggagtcatcttcaaccgtgctcctgcggacttcgatgaagccgccgccgccatgcaattggacggcgtgccgatctggggcgtcgtcaaaaacaatccggcgctgtcggcgccgcgcatgatcgacgtggcccgccatctgggcgctgaagtcatgattgagggcgacatcgcgacccggcgcatgcttgaaacagtcctctgcgggcgctccgtggccgaagtcattccgcgcctcaaacccggcacactggtggtcactgccggcgaccgcgacgatgtgatactggccactgcgctggcggccagcaacggcgttgagctggccggcctgatgctgacccaccacagcgccatcagcccgcggatcgaacgctttgcctcactcgcctttcacagcggcctgccggtgttgcgcaccgacggcgacagctatgaaaccgccgccagtatcagccgcttgcccctggcggtaccgcaggacgatctggcccggatggataacgtgatcgaaagcgtggccgaacagcttgatggcaatatgatttttgccggactggagcgtgccgcaccggcgcgcgtgtcgccaccggccttccgccaccagttgattcagaaggctcgggccgccaacaaacgcatcgtgctgccagaaggcgacgaaccccgcacgatccgtgcagccgttatttgcaccgagaaaggtatcgcgcgctgcgttttgctgggcaagcgcaaagtgatccattcggtggctgacgcgctggggatcgagctgccaaaagggcttgagatactggaacccagtgagatcgccgaacgctatgtggcgcccatggtggaactgcgcaagagcaaaggactgacgcccgggcaagccctggttgcattggaagacaccgtcgtactcggcaccatgatgctggcagtcggcgaagttgatggcttggtcagcggcgcggtgcacacgacggccagcacggtgcgccctgcgttgcagttgatcaagacggcgccgggttcgtcgatcgtatcgtcctgcttcttcatgttgatgcccgagcaggtcctggtttacgccgactgcgcgatcaaccccaatccgacggcccaggagcttgccgatatcgccaagcagagcgccgacagcgcactggccttcggcatcgaacccaaggtcgcgatgatcagctacagcaccggggaatccggatcgggtgacgatgtcgagaaggtccgcacggccaccgcgctggcgcatgcccgctggccggagttggtgctcgacggcccgatgcaatacgacgctgccgccgtgcgtgaagtcggcgagcagaaggcgccgggcagcgcggttgcggggcaggcgacggtttttatattccccgatctgaatacgggcaataccacctacaaagcggttcagcgttcagcgaaagtcgtgtcggtcggtccgatgctgcagggcttgcgcaagccggtgaatgatttatctcgcggcgcattggtcgatgacattgtgtttacgatcgcgctcacagccatccaggcagaggcgatggctcggcaatga

SEQ ID NO: 1502 - DNA, 2151 bp, Rhodopseudomonas palustris BisB18
atgactgccatgaacacgctcccccgccatcgcaccttctatctcgttccggtgtcccgcgacgcggggctcacctccgtgatgctgggtctggtcagggccctgcaactcaccggcgtgcgggtcggcgtggtcaagccggtcgcgcagcccgaggcgcatgccggcgatctcgatctcgcgccgcattttgcccgcactctgtgcggcgtcgccgcgccggatccgatcgcgttcgaccacgccgccgagatggtgcgctccggccagctcggcgggctgatggaagaagtggtgtcgatggtggaaaccgtgcgcgccgattgcgacgtggtgatcgtcgaggggctgatccccgacgtcgatttccagatcgccacgcggctcaacatcgagatcatccgctcgctcggcgccgatctcattccggtgttggccggcggcgcgcacagtgcggcggcgctggccgcgaaggccgccgccgccgccgagcaatatggcgacgacggccgccggccgatcgcgggcctgttgatcaaccgctgcgccgatgccgcggcggcgacggcgttgtccgcgctcggcgcgctgacgctgaagggctcggcgacgccggtgcggattctcgccgcggtgccgagcgccgcgcatctgcgggcgccgcggctgatcgacatcgccgaggatcttgggctgagcatcctcaaccgcggcgacatcgagagctcgcgggtgcagaccgtggtggtcgccgcgcgctcggcggagaagctgctcggcgatctgcggcccggaaccctggtggtgacgccggccgatcgcagcgacgccatcctcgcaacagcgttagtcgcgcaacgcggcatgccactggccggcttcgtgttcacctgcggcggacggccggcgcccgaggtcgcggcggtgctggcggcggcgccgctcgatcggctggcgctgctctgcaccgaggatgatacgttcatcaccgcctcgaagctcgccaacctgtcggcgcacgtcaaccgcgccgatgccgaccgcatggagcgggtgatctcgttcatcgccgagcaggtcgacaccgcgccgttggcggatcgtctcaacctgccggtcgacggcttgatgccgccgccggtgttccggcatcgcctggtcgagcgcgcgcgtgcggcgagccgccgcatcgtgctgcccgagggcgaagagccgcgcaccatccgcgccgccgcgatctgcgccgagaagcgcatcgcccgctgcgtgctgctgggcgcgccggaccgcatccgcgaggttgccgcggcgcacggcatcgacctgccggacgacatcgagatcgtcgacgccgagcagcagcgcagccgctacgtcgcgccgctggtggagcggcgcaaggccaagggcctcaccaagctgcaggccgagatcatgctggaagatgccgtggtgctcggcaccatgatgttggcggaagacgacgtcgacgggctggtgtccggcgccattcacaccaccgcctcgacggtgcgtccggcgctgcagctgatcaagaccgcgccgggctccagcatcgtctccagcgtgttcttcatgctgatgccggatcaggtgctggtctatggcgattgcgcgatcaacccggatccgaccgccgacgaactcgccgagatcgcgatccagtccgccgactccgccgcggcgttcggcatcgagccgcgggtggcgatgatctcgtattcgaccggcgcgtccggcgccggcgaagacgtcgacaaggtgcgccgcgccaccgacaaggtgcgggcgctgcgcccggatctgatcgtcgacggcccgatccaatacgacgccgccacggtggaaagcgtcggccggcagaaggcgccgggcggcccgctcgacggccgcgccaacgtcttcatcttccccgacctcaacaccggcaacaccacctacaaggcggtgcagcgctcggccaacgtcatctcggtcggcccgatgctgcagggcctgcgcaagccggtcaacgacctgtcgcgcggcgcgctggtcgacgacatcgtctacaccatcgcgctcaccgcgatccaagccgccgcccgcgacgccgacaaccggccggccgccgcgcaggctgccgagtga

SEQ ID NO: 1503 - DNA, 2136 bp, Rhodopseudomonas palustris BisB18
atgaatacgccgtcgcgccatcgtactttctatcttgtcccggtgtcccgcgatgccgggctcacctccgtgacgctcggtctggtcagggccctgcacctcaccggcctacgggtcgggttcgtcaagccgatcgtgcagcccgaggtccgctccggtgatctggaccttgcggcgcattttgcccgcaccttgtgcggggcctccgcgccggatccaatttcgatcgatcacgccgccgagatggtgcgctccggccagctcggcgggctgatggaagaagtggtgtcgatggtcgacacggtgcgcgccgactgcgacgtggtgatcgtcgagggtctcattcccaacgtcgatttccagatcgcgacgaggttgaacatcgagatcatccgctcgctcggcgccgatctcattccggtgttggccggcggcgcgcacagtgcggcggcgctggccgcgaaggccgccgccgccgccgagcaatatggcgacgatggccgtcggccgatcgcgggcctgttgatcaaccgctgcgccgatgccgcggcggcgacggcgttgtccgcgctcggcgcgctgacgctgaagggctactccacgccggttcgaatcctcgccgcggtgccgaacgccgcgcatctgcgggcgccgcgattgatcgacatcgccgatgatcttgggctgagcatcctcaaccgcggcgacatcgagagctcgcgggtgcagaccgtggtagtcgccgcgcgctcggcggaaaagctgttcggcgatctgcggcccggaactctggtggtgacgccggccgatcgcagcgacgcaatccttgcggccgcgttggtggcgcaacgcggcatgccgctggccggcttcgtgttcacctgcggcgggcgtccggcgcccgaggtggcggcggtgctggcggcggcgccgctcgatcggctggcgctgctctgcaccgaagatgatacgtttatcaccgcctcgaagctcgccaacctgtcggcgcacgtcaaccgcgccgatgccgaccgcatggagcgggtgatctcgttcatcgccgagcaggtcgacaccgcgccgctggcggatcgtctcaacctgccggtcgacggcttgatgccgccgccggtgttccggcatcgtctcgtcgagcgggcccgcgccgccatccgtcggatcgtgctgcccgaaggcgaggagccgcgcaccattcgcgccgccgcgatctgcgcggagaaacgcatcgcccactgcatcctgctcggcgcgccggagcgcatccgcgaggtcgcggcggcgcacggcatcgacctgccggacagcgtcgagattgtcgatgccgaacagcaacgcagccgctacgtcgcgccgctggtcgagcttcgcaaagccaagggcctgaccaaactgcaggccgagatcatgctggaagatgccgtggtgctcggcaccatgatgctggcgcaaaacgatgtcgacggactggtgtccggcgccattcacaccaccgcctcgacggtgcgtccggcgctgcagctgatcaagaccgcgccgggctccagcatcgtctccagcgtgttcttcatgctgatgccggatcaggtgctggtctatggcgattgcgcgatcaacccggatccgaccgccgacgaactcgccgagatcgcgattcagtcggccgactccgccgccgcgttcggcatcgagccgcgggtggccatgatctcctactcgaccggcgcgtccggcgccggcgaggacgtcgacaaggtgcgccgcgccaccgacaaggtgcgggcgctgcgcccggatctgatcgtcgacggcccgatccaatacgacgccgccacggtggaaagcgtcggccggcagaaggcgccgggcggcccgctcgacggccgcgccaacgtcttcatcttccccgacctcaacaccggcaacaccacctacaaggcggtgcagcgctcggccaacgtcatctcggtcggcccgatgctgcaggggctgcgcaagccggtcaacgacctgtcgcgcggcgccctggtcgacgacatcgtctacaccatcgcgctcaccgcgatccaagccgccgcccgcgacgccggcggcaagttggccgcggcggcagagtga

SEQ ID NO: 1504 - DNA, 2142 bp, Rhodopseudomonas palustris BisA53
atgaatacgcccttccgccatcgtaccttctatctcgttccggtctcccgcgaagcggggctgacatccgtgacgttagggctcgtcagagctttgcaattggcgggcgtgcgagtggggtacgtgaagccgatcgtgcagcccgaagtgcgttccggtgatttggatcttgcagcgcatttcgcgcggacgctgtgcggcgcgtccacacccgagcctatccccttcgaccacgcggccgaaatggtccgttccggccaactgggcgggttgatggaagaagtggtgtcgatggtcgaaacggttcagcccgattgcgacgtcgtcattgtcgaaggcctcattccggatgtcgattttcaaatcgccacgcgactgaacatcgagatcgtccgatcgctgggcgcggatttgatcccggtgctcgccggaggaaccctggatgccgacggcctggccgaaaaggctgccgcggctgcggagcagtacggcgacgatggccgccggccgatcgcgggcgtgctgattaatagatgcgccgatgcagccgcagcggcggccctgaccgaggtcggcgcactgacgctcaacggcgcgtctacgccggtcccaattctcgccgccgtgccgaatgccgaacatcttcgggcgccgcgtctgatcgacatcgcccaagaactcgaactcaagatcctcaatcgcggcgacattgaaacatcgcgcgtgcaggcgcttctcgttgctgcccgctcgccggagaagctgctcggccacctgcgaccgggaaccgtggtgatcacgccggccgatcgcagcgacgctatcctcgtgacggcgctggtcgctcaacgcggcatgccgctcgccggctttgtcctcacttgcggcgggcggccggcgcccgaagtttcggcgattctggcggcagcgccgctcgaccgcctgccgatcctcggcaccgacgacgatacattcaccacggcgtcgcggctcgcgagtctgtcagctcacgtcagtcgcgccgacggcgaccgcatggagcgcgtgatctcgttcatcgccgaaaaggtggacacggggccgctggcgcgtcgactgaatttgccggtcgatgccctgatgccgccgcccgttttccggcaccgcctggtcgaggcggcgcgcgccgccaatcgccgcatcgtgctgcccgagggcgaagagcctcgaacgatccgcgccgcagcgatctgcgctgagaagcgcatcgcccactgcatcctgctcggggcacccgaccggatccgcgaagtcgccgcagcgcacggcatcgacctgccggacaatgtcgaaatcatcgatgcggagcagcaccgcagccgctacgtcgcaccgctggtcgagcttcgcaaagccaagggcctcaccaggctgcaagctgaaatcgccctggaagatagcatcgttctcggcaccatgatgctggcggaaaaccatgtcgacgggctggtgtccggcgccgtgcataccaccgccagcacggtccgccctgccctgcagctgatcaagaccgcgccgggctcgagcatcgtatcgagcgtgttcttcatgctgatgccggatcaggtgctggtctatggcgactgcgcgatcaaccccgatccgaccgccgatgaactcgccgagatcgcgatccagtcggccgactcggcgtccgcattcggcatcgagccgcgcgtggcgatgatctcctattcgaccggcgcttcgggtgcgggcgaggacgtcgacaaggtgcgcagggcgacgatcaaggtgcgcgctttgcggccggacctcatcgtcgatggcccgatccaatacgacgcggccaccgtggagagcgtcggtcggcagaaggcgccgggcggtccgctcgacggccgcgccaacgtcttcatcttccccgacctcaacaccggcaacaccacctacaaggcggtgcaacgctcggccaacgtcatctcggtcggcccaatgctgcagggcctgcgcaagccggtcaacgacctgtcgcgcggcgccctggtcgacgacatcgtctacaccatcgccctgaccgcgatccaggcggcggccggcgacgccggcgccaagtcagcggttgccgccgcggcggagtga

SEQ ID NO: 1505 - DNA, 2079 bp, Burkholderia oklahomensis C6786
atggcgctcggcctggtgcggtcgctgcaactcgccggcgtgcgcgtcggtttcgtgaagccgatcgcgcagcccgaagcgtcgacgcgcgatcgcgatctgtcgagccacttcgcacgcacgctgtgcggcacgacgacgcccgagccgatcccattcgcccacgccgccgagatggtacgcgaggggtgccttgccggtctgatggaagaagtcgttgcgatcgtcgagagcgcgcgcgaaggcaatcacgtgatgatcgtcgagggcttgattccctatgtcgacgcgatgatctccacacgcttgaacatcgagatgatccgttcgatgggcgccgatctcgtgcccgtggtcacgggcggcacgcgcggcgcgacggagctggcagccattgcggccggggcggccgaacagtacagcaacggcggacggcgtccgctcgccggcgtgctgatcaaccgctgccgcggggcgaacgcatccgcgctcggcaaattgacgagcctccatctcgaacgatcggcgcgcgaggtgccgatcctcgcggcggtgccgaccaatgtgcagttgaccgcgccgcgcctgatcgacgtcgcggccggtctcgacctgaccgtgttccggtccggcgatatcgaaacggcgcgcgtggaaaacttcgtggttgccgcgcgctcgccggaaaagctgattcctcatttcaagagcggcacgctcgtggtcatgccggtggatcgctccgacgcgattctcgccgtggcgttcaccgcactgcgcgggatgccgctcgcgggcctgatcctgacctgcggcggcgagccggatcccgaagcgataaagctgctcgaagcgccgccgctcgaccgcctgccggtcctgctgtcggacgaagacacgttcacggttgcttcgcgcctgacgggcctgtcgagccacgtgttcgccgacgacgccgtgcgcatggagcgcgtgctcgatttcatcgcgggcaacgtccatgtggagccactcgtcgcgcgcctggacgcgccggtcgaaacgttgatgccgccgcccgtcttccgccatcgcctggtcggcaaggcacgctcggccgaccgccgcatcgtgctgcctgaaggcgacgagccgcgcacgatccacgccgctgtgatttgcgcggagaagggcattgcccgtccgatgctgctcggcgcgcccgatacgattcgctcggtcgcggctggtcacggcattgagctgccgaagtcggtcgaaattctcgatccggaaacgatccgcgacgcctatgtcgagccgatggtcgagctgcgtaaatcaaaggggctcaccgcgctgcaagccgcgaagcagctcgaagacacggttgtgctcggcacgatgatgctggcgcgaggcgatgtcgacggcctcgtctcgggtgctgtccacacgacggccaacacggttcgtcccgcgttgcagttgatcagggccgcgccgggtaacagcgtcgtatcaagcgtgttcttcatgctgatgcccgaccaggtgctcgtctatggcgactgcgcgatcaaccccgatccgagcgcggaggaactcgcagaaatcgcgatccagtcggccgacagtgcgaaagccttcggtatcgatccgcgcgtcgcgatgatctcgtactcgacgggctcgtcgggctcgggcgacgacgtcgagaaggtgcgcgcggcgactgcgctcgtgcgcgaacgccggcccgatctcgtcattgacggcccgatgcagtacgacgctgccaccgtggaggccatcggcaagcaaaaggcgccaggcagccccgtcgccggccgcgccaacgtctgcatcttcccggatctcaacacgggcaacacgacctacaaggcggtgcaacgctccgcgaacgtggtctcggtcggcccgatgctgcagggcctgcgcaagccggtcaacgacttgtcgcgtggtgcgctcgtcgacgatatcgtctacacgatcgccttgaccgctattcaggccgctgctggcggcgggaatccgaatcgcgcggtaccgccggctccagccgttgccgcataa

SEQ ID NO: 1506 - DNA, 2112 bp, Rhodospirillum rubrum ATCC 11170
atgcccgcacgcatgttctttctcgccccgatggcccaggatgtcggactgacctcggtggcccttggtctggcccgcgcccttcagcgcgacggcatcaaggttggcttcgccaagccgatcggccatgccgaggccgatggcgagcccggcgatccgtcgagccatttcgcccgcagcctgtgcctgctggaggccccggaatcgatcgccttcgcccgcgccgaggatcaggtgcgccggggcgatctggccgccctgatggaagaggtggtcaccctggtcgacggcctgcgcgccagccatgatgcggtgatcatcgaagggctgatcccaggggccgatacccaggtggccgggcggttgaacgccgagatggcgcgggctttgggggccgatctgatccccgtgctgtcgggggcgggtcgcgatggcgccgatctggccgaggccatcgccctggcgcgccgccagtatgatggcgcccagaacgcggccttcgccggggtgctgatcaacaaggtctcgccctcccatggcgccgagctgcgcggcgatctggagcgggcggtgggcgaacgcctgcccattctcgccaccattccctttgaaacccgcctgcagtcgccgcgtctggccgatgtggtgcgcggcctgggcctgaccgtcgagcacgagggcgcgcttgctcaaacccgggtgcgcgagatcgtcatcgccgcgcgctcggtggaaaacatcatcgaacgcctgcggccgggcgccctggtcgtcaccccggtcgaccgcatcgatatcgtgctggccgccaccctggccagcctgcgcggcgtgccgctggctggcgtgttgctaacctgtggcggatccctgcccgataccgtggcctcgctggtgctttccgcccggcccgaggggctgccgatcctgtcgaccccggccgacacctatgccaccgccagccggctgtcgcgcttgagcggccatgtcggcgccgatgatcacgcgcagatggaagaggtgatcgacttcatcgccgagcagatcgccaccgcgccgttgcgccggcgcatcggcgagccgggcgaggtgcggatgtcgccgccggccttccgcaaccgcttgatccaaagcgcccggcgggcggccaagcgcatcgttttgcccgagggcgacgagccgcgcaccctgcaggcggccatcgcctgccacgccaagggcatcgcccgctgcgtgctgctcggccatcccgcccaggtccgtcaggtcgcgagcgcccaggggctggagatccccgccgatctggaaatcctcgatcccgagctggtgcgcgggcgctatgtcgaggctttggtcgagatgcgccgggccaagggattgaccgcccttcaggccgccgcccagcttgaggacacggtcgtgctgggcacggtgatgctggccttgggcgaggtcgacggtctggtctcgggcgccgttcacaccaccgccagcacggtgcggccggccctgcagctgatcaagacggcgccgggcgccagcatcgtttcaagcgtgttcttcatgctgatgcccgatcaggtgctggtctatggcgattgcgcgatcaatcccaatccgacggccgagcaactggccgatatcgccatccaatcggccgatagcgccctggcctttggcatcgagccgagggtggcgatgatttcctattccaccggcagttcgggggtgggcgacgacgtggagaaggtccgcgccgccaccgccctggccaagctcaagcgccccgacttgatgatcgacgggccgatgcaatacgacgccgccagcgtggaaagcgtcggccgccagaaggcccccgacagcccggtcgccggtcgggccaatgtcttcgtcttccccgacctcaacaccggcaacaccacctataaggcggtgcagcgctcggccaatgtggtcagcgtcggcccgatgcttcagggcctgcgcaagccggtcaatgatctgtcgcgcggcgccctggtcgacgacatcgtctataccatcgccctgaccgccatccaggccgaccagggggccgatccgatggccgaaaaagtcgccgccgagtaa

SEQ ID NO: 1507 - DNA, 2064 bp, Rhodopseudomonas palustris BisB18
atgaccaaaattaaacatccgcgtgggctgtttgtcgccccagcctcgtcggacttcgaggtttccgccatctcgctcgggctcgttgactcgcttagagcccgcggcctcgcagtgggctacgtcaagccgatcggcgatcccggcgcgatgctaaacgaccgctcctcggccttcgcccgtcgtatgttcggcctcaagacgcccgaggccattccggcggagcgtgcagaacaaatgatcatcgccggacgctcggcgacgctgctcgaagaggtggtggcgctcgtcagcgagttgggcgacgatctcgacatcgttgtcgtcgagggcgctgcgcttgccgacggccacggtctgctcgccgagttcggcttcgcggtggcgcgcaacctttcggccgacgtcatccctgtgatcagcgggcgcgacagcggggcggcacgaatcggcggtgcactgatcgacgccgtccatcgcgccggcggggcggagagctgcgcgggcgcgatcgtgattcgttgcccggacggggagctcgcgccgctgcgcgatctgtctttgcccgtgcggttgctcggagtgctacccgaggaccccggcctcgccgcgccgcgtctttccgatgtcgtcgccgatctcggcttcgaggtgctgcattccgggcagctcgccgacgcgcgcatgcgcgacgtgatcgttgcggcccgcgggcccgagcatatcgtcgacctgctgcgccctggaacgctcgtcgtcacccctggcgatcgccacgatgtcgtcatcacgacggcgctcgcctccaccagcggcatgccgatagcgggattgctgctcacctgcgctgccgctcccaccgattcgctcaatgctttcctgatgccgcgcttcggcgggttgacggtgctcaagaccgaactgcaaacgttcgaggcggcgatgaagctcggcgagttcgaccgcggcgtgcgcagcgacgatgcccggcgcatggaacggctgatcgctcacgccagcgagaacctcgacctcagtctgatgtcgacggcatcgaagcgcagcagcggcgaagccatgccgccgccggtgttccgtcacaaactgatccgcgccgcccgcgccgccgcccgccgcatcgtgttgcccgaaggcgatgagccgcgcacgctggccgccgccgccgattgcacgcgtcgcggcatcgcgcactgcgtgttgctgggcgagtgttccgaggtgcgcaacgtcgcggcccgttatggtgtcgacctgcccggcgacatcgaaatcctcgatccggccagcctgcgcgccagctatgtcgagccgatggtgcgattgcgcaagtccaagggactgacgcccgaggaagcgctgtcgcagcttgaggacaatgtcgtcctcgccacgatgatgctggccgaggggcatgtcgatgggctcgtatccggcgccgtacacaccactgcctcgacggtgcgcccggcgctgcaactgatcaaaaccgcggccggcagctccttggtgtcgagcgtgttcttcatgctgatgccggatcaggtgttggtctacggtgactgcgcggtaaatcccgacccgactgccgagcagcttgccgagatcgcggtgcaatcggccgactccgccgccgccttcggcattgagccaagggtggctatgatttcctactcgaccggtgaatcggggacgggcggcgacgtcgacaaggtccgggcggcgacggagattgttagaaagctgcggcctgaactcgcggtcgatgggccgatccaatacgacgcggcgacagttgaaagcgtcgggcggcagaaggcaccgggcagtccggtcgccggtagagccaatgtgttcgttttccccgacctcaacaccggcaacaccacctacaaggcggtgcagcgttcggccgacgtcatatcgatcggaccgatgctgcagggacttcgaaagccggtcaacgacctgtcgcgcggcgcgctggtcgacgacatcatctacaccatcgccatcaccgccatgcaggcggcccaagcgaaataa

SEQ ID NO: 1508 - DNA, 2082 bp, Chromobacterium violaceum ATCC 12472
atgcagacattcttcctcgcccccaccggcttcaatgccggcctgacctcggtcacgctgggcgccatccgttcgctggagcaggccggcctgcgcgtgggcttcgtcaagcccatcgcccaggacaccaaggacggcgaagccgagcgctccacccacttcgcccaggccatctgccgcctgaatccgccgcagccgatcagcatggaacgcgtcgaatacctgctgtcgcaaggccaggtcgatcaattgatggaagaggtggtcagcctctaccagcaggccgcgcaaaacgtggacgccgtgatcgtggaaggcctggtgccggaccagaagcaggtgttctccaccttcctcaacaccaagatcgcccgcaacctgcaggcgcagaccatcctggtcagctcggtgaaggaattgggcgccgcggaaatcgccgaacagctcgagatgaacatccaggccttcggcagccaggccatcgccggctacatcctcaaccacgtgctgcccgccgtcgaccgcgccgagctggcgcgcgaggtgcgggaatccggcaacctgaagaaagccggcctgccgctgctgggcgtgattccctaccagtccgagctgctggcgccgcgcacgcaggacgtggcccgctacctgaacgccaacgtggtgcatgccggccagcaggccagccgccgcgtgcgcaacatggtggtggccgcccgcaccgcgcccaacatcgtcaatctgctgaagccgggcgcgctgatcatcaccccgggcgaacgcgaagacgtggtgatggccacctcgatggcagcgatgaacggcgtgccgctggccggcctgctgctgacctgcgactcccagcccgacccgcgcatccagcagctgtgccaacaggcgttcaccggcggcctgccggtgctggccacttcgctgaactcgatggaaaccgccggcgcgctgaacgcgatgagccaccaggtgccgtccgacgacctggagcgcatggagaaggtgatcgagcacgtcgccgaattcctcgacgtgtcctcgctgaagcaaagcgtcggcgagccgcgcgaactgcgcctgccgccgccggccttccgcttccaattgatggaaaaggcccgcaaggccaacaagcgcatcgtgctgccggaaggcaacgagccgcgcaccatccaggccgccgccatctgccaggaaaaaggcatcgcccgctgcgtgctgctgggcaaccgcgccgaaatcctgcaagtggccgaaacccagggcgtgacgctgccggaatcggtcgaaatcctcgacccgaacgaaatccgcggccgctacgtcgagccgatggtcgagctgcgcaagggcaagggcctgaacgcgccgatggcgctggcgcagctggaagacaccgtggtgctgggcaccatgatgctggcgatgaacgaagtggacggcctggtttccggcgccgtgcacaccaccgccaacaccatccgtccggcgctgcagctgatcaagaccgccccgggctccagcatcgtgtcctcggtattcttcatgctgatgccggaacaggtgtacgtttacggcgactgcgcggtgaacccggacccgaccgccgagcagctggccgacatcgccatccagtccgccgattccgccgtcgccttcggcatcaacccgcgcgtggcgatgatctcctactccaccggctcgtccggcagcggcagcgacgtggagaaggtgcgcgaagccacccgcatcgcccaagagaagcgccctgacctgctgatcgacggtccgatgcagtacgacgccgcctcggtggaatccgtcggccgccagaaggccccggacagccaagtagccggccgcgccaccgtgttcgtgttcccggacctgaacaccggcaacaccacctacaaggcggtgcagcgctccgccaacgtggtctcggtgggtccgatgctgcaaggcctgcgcaagccggtcaacgacctgtcgcgcggcgcgctggtggacgacatcgtctacaccatcgccctgaccgcgctgcaggccgagcagacgccggccagctaa

SEQ ID NO: 1509 - DNA, 2088 bp, Lutiella nitroferrum 2002
atgcagaccttctttctggccccgctgggctttgacgccgggctgacctcggtggcgctgggcatgatccgcgcgctggagcaggccgggctgcgcgtcggtttcgtcaagccgatcgcccagggtgccggccatcacgaacccgagcgctccacccacttcgcccgcgccatctgtcacctggcctcgccggagccgctcacgatggagcgggtggagcatttcctcagccagggccaggtcgaccagctgatggaagaggtggtcagcctgtaccagcaggcggcccgcaacgtcgacgtggtgatcgtggagggactggtgccggaccagaagcacccctactccacctttctcaacacccggatcgcacgcaacctgcaggcgcaaaccatcctggtcggcgccgccgacaagctggccagccacgagatcgcggaacagctggaaatcagcatccaagcgttcggcggcgaccacggcagcaccgccggctacatcctcaaccgcgtctcgaagcagcatgacaccgcgcagatggcgctggagatcctggagtcgagccaggcgctgcagcacaaccgcctgccgctcttgggcgcgattccgctcgaacccgagctgttggcgccgcgcacgctggacgtggccaactatctcaaggcgcgcctggtgcacgccggccagatgacgcgccgccgcgtgcgcagcaccgtgatcaccgcgcgcaccgtgcccaacatcgtgcacctgctgaaaccgggcgcgctgatcgtgacgccgggcgaccgcgaggacatcgtgctcgccaccgccatggccagcatgaacggcgtgccgctggccggcttgctgctgacctgcgacgcgatgccggatccgcgcatccagcagctgtgccaccaggccttcaccagcggcctgccggtgctggcttcggagtcgaacacgctggaaaccaccagcctgctgaccaatatgagcctgcaggtgccggccgacgatttggagcgcatggaacaggtgatcgacttcgtcgccgagcacctcgacgccaaggcgctgcgcaaccgtgtcggcgcgccgcgcgagcaccgtctgccgcccccggcgttccgcttccagctgatggaaaaggcgcgccaggccaacaagcgcatcgtgctgccggagggcaacgagccgcgcaccatcaaggccgccgcgatctgccacgagaagcgcatcgcacagtgcgtgctgatcggcagccgcgccgagatcgaacaggtggccgaggcgcaaggcgtggcactgccggccgacatcgagatcatggacccgaacgaggtgcgtggccgctacatcgagccgatgatcgaactgcgcaagaacaagggcctcaacgcgccgatggccgagcagcagctggaggacaacgtggtgctgggcaccatgatgctggcgctggacgaggtggacggcctggtgtcgggcgcagtgcacaccaccgccaacaccatccgcccggcgctgcagctgatcaagaccgcgcccgaggcgaaactggtgtcgtcggtgtttttcatgctgatgccggagcaggtgctggtctacggcgactgcgcggtgaacccggacccgagcgccgacgaactggccgacatcgccatccagtcggccgattccgccgccgccttcggcatcccgccgcgcgtggcgatgatctcctactccaccggctcgtccggcagcggcgacgacgtggagaaggtgcgcgaagcgacgcggctggcgcgcgagaagcgccccgacctgatcatcgacggcccgatgcagtacgacgccgccagcgtggagagcgtcggccggcagaaggcaccggacagcccggtggcaggccgcgccacggtgttcgtgttccccgaactcaacaccggcaacaccacctacaaggcggtgcagcgttcggccaacgtggtcagcgtcggcccgatgctgcaggggctgagaaagccggtgaacgacctgtcgcgcggcgcgctggtcgacgacatcgtctacactatcgcgctgaccgcgatccaggccgaccagcaggctggctga

SEQ ID NO: 1510 - DNA, 2148 bp, Psychrobacter sp. PRwf-1
atgcaaactattttgctggtccctaccggtcgtggtattggccttacatctgcaggtcttggtctgattaaagcgttcgattacttgggcataaaagctggctttatgaagccatttttgcaagatgactcgtatgattcacagcacaccttagacagctcaagtgagcttgcgcacaaagcttttggcttaacaccgcctgagtctatcccccgtgagcgtgttgagcgcatgatgaatgcgggcaatgttgatgacttaatggaagatgtggttaccaattttcataagttagatgacggctacggcgtggtggtctgtgaaggcttggtgcccacagaggaagtcaattacgcctcgcaagtcaactatgcgttggccactgcgcttgatgccaaggttattttcgtgagcatggctgaccttgaaaaccccaagcaattggcggataaattagacttacacgcacgtgcgttcggtggcttaaccggtgagcgtactttgggcagtatcttaatgcgtgccaataacgtacccaatacctttgatacgcagccagtcgcaccaggtgaggccacacttgagctggatgctgaatttatcgaagcgatgcaaaaatactctccaaactttgccaccgaaaaatatcatctcattggtgtggtaccgtttagcaacagcttgtctgtgccgcgcacatgggacatcgcccagcagttaaatgccacttggcttaaccaaggtgaggcaaaacagcgccgtgtgttaaaaaccagcctagcggcgcgtaccatctcgcgtgtgggtgaaatcttcaaccgcggcaccttgattgtgaccccaggcgaccgtgatgacttgttattggccacagcgatggctgccatgaatggtatccccatggctggtatcgtattaaccggtggtatcatccccaacgatactgtatttgagctgtgtcagcctgcgctaaaaaccggcttgcccattatgagcgtaccgaccaatagcttagagacagtgaccaacttatttaacatcagtaatgaaattccacgagatgatgtggagcgtgctgagactgtgacccgcttcgtggctgcgcacttagatctaaattggctgaagtcttactttgagcgcgactataagcctcgcttgtctccctcagcgtttcgtcatcaagtggtcaaaaaagcacaacaagccaaaatgcgtgtggtgctccctgagggcgaagagccacgcaccatcgaagcggccgccatctgtcaaagccgcggcattgcccagtgtgtgcttatcggtaactctgatgagattgcccaagtggccaaaaaccgcggcgtagatctgccaaaagacatcgaaatcatcgatccggccaccctcaatttagacaaatacgttgccgcttttgttgagcgccgtaaaggcaaagcctctccagagcaggccgctgaacagctaaaagacaccgtggtattgggcaccaccatgctgcatatggatgaggtggatggtctggtgtcgggtgctattcataccactgccaataccgtacgtccggctttccagttaattaagacagcccctcagtactctcttgtctcctctatcttctttatgttactgcctgaacaagtggtggtctatggcgactgtgccattaacccagaccccaatgctgagcagctagcagagattgccattcagtcggccgcctctgccaaagcctttggtattgagcccaaagtggcgatgattagctactcaaccggcgcctctggtaccggcgacgatgtagaaaaagtcaaacaagccactcaaattgtacgtgaacgtgcgcctgatttaatggtagatggcccactacagtatgatgcagcctctgtgcttagcgtgggcaaacaaaaagcgcctgactcacctgtagcgggtcaagctaacgtgtttatcttccctgacttaaacaccggcaacaccacttacaaagcggtacagcgcagtgccaacgtcgtcagcgtcggcccgatgctacagggcttaaacaagcctgttaacgacttatcacgcggcgctttggttgatgatatcgtgtacaccatcgccttaaccgccattcaagccagcagctctgagatttaa

SEQ ID NO: 1511 - DNA, 2157 bp, Psychrobacter cryohalolentis K5
atgcaaactattttacttgtgcccattagccgcggtatcggtgtgacgtcagcggcgttaggcttgattcgtgctttcgattataacggtatcaaagcgggttttatgaagccgtttttacaagacgatacgctggataagcaaaacagtctagacagctcaagcgcattagccatgcatgcatttggactaaagccacctaaatcgatcagccgtcaacatgttgagcgtatgattggtgatgacaatcttgatgacttgatggaagaagtggttgttaactaccatactcttggtgatgattacgatgtggtgatttgcgaaggcttagtaccgaccactgaaacttcttatgcctcacagatcaaccgtgcaattgctcatgcactcgatgcccgaatcatctttgttagcaccgccgataccagtaaacctgcctatttagccgataagcttgatgtccatgcgcgtgaatttggtggtatggcaagtgatcgtacgcttggctgtatcttgatgcgtatgcatgacttgccgaatacgcaaagcaccttagaaaatcaaatcgttgcccctggtgaagcgattgtgagcttggatagcggctttatacaagaagtacaacgcttatcgccgcactttaataccgaacaattccgcttaattggtgtcgtaccatttagtgactcattatccgtgcctcgtacgtgggatatcgctgctgaacttgatggtacttggctcaacgttggtgaggcaaaatcgcgccgtatcaatcgcatcagcttgactgcacgctcagttgcacgtgttgatgaagtgttcaaacgtggtacgcttatcgtggtgccgggcgaccgtgacgatttattattggcggcgggtcttgcctgtatcaatggtattccgctagcaggattggtattgactggcggcgttgtccctagtccaaccgttgctgagctttggcaatctgcactcaaaactggtattcctgtgatgagtgtcgaagatgacagctttgagacggtacaaagcctattacacatgagtgctgagattccaagtgatgacaccgaacgtgctgaagaagtggctcgttacgtcgcggcgcatttagatttgagctggattaaagcatattttagccaaaatcatgagccacgcttgtcaccttctgcttttcgtcatcaagtggtcaaaaaagcgcaaatcgccaaaaaacgtatcgtgctgccagaaggctctgaaccgcgtacggtcgaagctgcttgtatctgtcaaagccgcggtattgccaactgtgtgctactcgctaagcgtgctgatgttgaacaagtcgccaaaaaccgcgatttggtattacctgaagggcttgaaatcatcgatcctgacagcttagatatgagcaaatatatcgccgctgtagtcgagcgtcgcaaaggtaaaaccagcgcagaagtggctgctgaatatctgcaagataccgtttatttaggtacgaccatgctacagatggacgaagttgatggtctggtctctggggcaattcataccacggcgaatactgtccgcccagcgtttcagttgattaaaacggctcctgagtattcacttgtatcgtcagtcttctttatgctgttgcctgagcaagtggttgtctacggtgactgcgccattaatcctgatccaaatgcagaagaattggctgagattgccattcagtctgcgcagtctgctgccgcctttggcatcgatccaaaagtggcaatgattagctactctacgggctcgtcaggcactggcgctgatgtcgaaaaagtcgcccgtgcgacccaaatcgtccgtgaacgtgcgccgaatctaaaagtcgacggaccgctacagtatgacgcggcttctgtcatgagcgtcggcaagcaaaaagcgccggattcgcctgttgctgggcaagcaaacgtctttattttcccagacctaaacaccggtaacacgacttataaagcggtacaacgtagcgccaatgtggtcagtgttggaccgatgttgcaaggcttaaacaaaccagtcaatgacttgtcacgtggtgccttggtcgatgatattatctataccatcgccctcactgccatccaagcacatagcgacgttatttaa

SEQ ID NO: 1512 - DNA, 2145 bp, Enhydrobacter aerosaccus SK60
atgcaaactattttatttgtgcctaccagtagtggcattggcttgacctcagcttgtttgggttttatccgtgcacttgattatatcgggctaaaagcaggatttttaaaaccctttagccaaaacaccaccgccaatcatgagagtgatgacagctcaagcgtgcttgcaaaacatgcctttaacttaaacccgccaacatccattgaccgtagccgcttagagcgtgtgattggggatggtcagttggatgacttgatggaagaagtggttgccaaacaccaagcattggctgagcaatatgacgttatcgtgtgtgaaggtctggctgccgacaatgattcaagttatgcagaattggtgaatttagccatcgtcaacgcgctagatgccaaagtcatcttggtcagtagtggcgatattgcaaaccctgatagtttggtggacaaactagatatttttgcccgtgattttggcggtatggcaagcgagcgtacgctaggcacgattttgatgcgggttaaaaacgtggacaaccactatgatgaagcacccgtcgcgcctggtaaagccaaagttgatttggcagcggagcagttacaggcgattaaatcccactcgccttattttgactccgataaatttcgcttgattggcgtagtgccttttagtaacaccttaagtgtcccccgtacctgggatgtggctcgtgagcttgatgccaaatggctcaatgaaggcgacgccaaaaaccgtcgtgtgctcaatactttactggttgcgcgtaccgttgccaatattgaagattctttcacccgtggtaacttactggtgacggcaggcgaccgagacgatttgattttggcgactgcgcttagcaccatgaatggtgtaccgctagcaggtcttattctgacaggcggtatcgtgccgaaccaaaaaattatcaatctgtgtcgccccgcgctaaaaacggggattcctgtgatgctggttgacactgacagctttgatactgttaccaaacttaaccacatcagccatgaaatccccgcagatgataccactcgcgccagtgaagtcaccgattttgtcgccgcgcatttggatttggactggatcaaaaccacttttagtcaaggcaacaacaaccgcaaactctcgccttcggcttttcgtcataccttggtcaaaaaagcccaagccgccaaaaaaaccatcgtattgcctgagggcaatgagccacgtacggttgaagcggcggtcatctgtcaaaatcgtggtattgcccattgtatcttacttgccaaacgcagtgaggtcgaagaggttgccaagaacttggggctcaccctacctgaaggcctgcagattcttgacccagaaagcttgattgacaagtacgtcaagcctatggttgagcgccgtaaaggcaaactcgatgaactacaagcccgtgagcagctcaaagacaccgtcgtactgggtaccatgatgctgcacttgggtgaagtcgatggtctggtatctggcgccgtacataccaccgccaatactgtccgcccggcgtttcagttaattaaaacagcgccgcagtattcactggtttcgtctattttctttatgctactgcctgagcaagtggtggtgtatggtgactgtgccatcaacccagaccctaccgcagaacagttggctgaaatcgccctacaatccgcccaatctgccaaagcgtttggtatcgaacccaaagttgccatgattagttactcgacagggtcatcaggtgaaggcgcagacgtggataaagtgcgtcaagccaccgaaatcgccaaagccaaagcgcctgatttgctcattgatggtccgttacaatatgacgctgccagtgtcgcaagcgtggcaaaatcaaaagcgccaaattcgctggtggcaggtcaagccaatgtgtttatcttcccagatttgaacactggcaataccacctataaagcggtgcagcgctctgccaacgtggtgagcgtcggtcctatgctccaaggtctcaacaagcctgtgaatgacttgtcgcgtggcgccttagttgaagatattgtctataccattgcgctcacagccgttcaagccgatagcggtgagttttaa

SEQ ID NO: 1513 - DNA, 2145 bp, Acinetobacter radioresistens SK82
atgaatacaattctactgattccaactggagaaggtgtcggtctgacttcagcctgcctgggaatgatctatgcactggactgtaatggtattaaggcaggatttttaaaacctttttctgaatcttttcaggaaaatgatcagaaccgtaccactagcctgtttgaacatttattccagaccagtacggttgaaccgattgcatatgaaagagttagccagctgatcgcactggaagaaatggatgaattgcttgaggaagcagtcagcctgcatcgcagtattgccaccaaacatgatgtgattattgtagaaggcttactgccaaatcatgaagaccagtttgcaggtgagttaaatgccgcccttgcacaggcactagatgccaaggtaatcctggtcagtactgcagacgtacagaatccgcgtaaaaccgctgaaaaaattgaagcacatctacgccagttcggtggcgctgcttcagagcgtacagcaggtgtgctgttcatgcggactaaaggcttacctgaagaagttgcacagattccggtgaccattgatccttcactgcgtttaagtgcagaaattgcaaccttcacgatagagctgcaaaaatataaccgttatttagggactgctgacttaccgattattggtctggttccatttagcaataccctgagtgttccacgtacactagacattgcccgtctgattcagggcgaatggattcatcagggggaagcacggcagcgtcgtgtattacatagcagcctgattacctcaagtattgaatatgagctgaacaaatttgttgccggtgaactgattatcagtgcttccgaacgtaccgatgtactacttgccagcagtttagctaccagtcatggtataccgctagcaggcctggtactaaccgagcgtcaggcacccaatgcccagattctgaatttctgccagaatgctatcaaacagggactgcccattttacatacgcagctgactactctggaaacagcacagcgtctggcaaatctgagcaatgaaataccggttgacgatacagaacgtgccgagcaggttacccgttttgtctccagtcatattgatctggactggctgacccagcaaatcaatggcaatgcaactccccgcctgtccccttcagctttccggcatgaactggttcagaagtcgattgctgcgaaaaagcgcatcgttctaccagagggtgatgaacctcggactattcaggctgcggcgatctgccagtctcgcggaattgctcactgtattttgctagccaaaccagaagcagttttagaaattgccaaagcccgtaatattgaattaccagacgatcttgaaatcattgatccggatactattcgtagccagtacattagcagtatggtcgagctgcgaaaaggcaagatcaatgacattcaggccaaagaacagttacaggatactgtagtgctgggcaccatgatgctggcactggatcaggttgacggactggtttctggggcggtacataccacggctaatacagtgcgaccggcatttcagctcattaaaacagctccagaatattcactggtctcttcagtattctttatgctgttaccagatgaagtctatgtatatggggattgtgctattaatcccgatccagatgcccagcagcttgctgagattgctatccaatccgcagattcagccagagcatttggtattgacccgcgtattgccatgatcagttactcaaccggaacctcaggtaccggtgccgatgttgataaagttcgtgaagcaacagagattgcccgtcaacgtcgccctgatctgttgattgatggtcctttgcagtatgacgctgcgtctgttgaaagcgtgggccgccagaaagcacctgagtcacctgtagcagggcgcgccaatgtctttatcttcccagacctcaatactggcaacacaacttacaaggctgtacagcgtgctgcaaatgtcgtaagtgtcggcccaatgctgcaaggactgaacaagccggtaaatgacctgtcacgcggcgctttggttgatgatattgtttttacgattgctttgactgccattcaggcagaacaacaggcgacagtataa

SEQ ID NO: 1514 - DNA, 2163 bp, Acinetobacter sp. ADP1
atgaatacaattttaatgatcccgactggcgaaggtgtcgggttaacttcagcctgtcttgggctgatttatgcactcgattgtaatggaattaaagcaggttttttaaagccattttcacaagaacttcccaatcaggttgatcgtacgacctcactgtttagccatctttttcaaggcaagacagtaacttctatttcacacgaaaaagtattgcaacgtcttgctttgggcgaacgagatgagcttcttgaagaagccgtgagtattcatcgtaatgttgcggcaaattatgatgtgattattgtggagggtttacttccaaacgcacaggatcattttgcgacagaactcaatgctgcactcgcacaagcactagatgccaaagtcgttttggttagtactgccgatgttcaaaacccacgccgtactgcggaaaaaattgaagctcacctgcatcactttggtggagtttcatccaatcgtaccgcaggtgtgctttttatgcgtacacgaggcttacctgaagaaacggcacaaatcccgcttactatagatccatcactccgcctcaatacagagattgcagcttttagccaagaattgcagcgctataaccgtaatctgggtacaaccaccctaccgatcattggtttagtgccttttagcaataccttgagcgtcccacgcacactggatattgcatccatcattgagggagactggattcatcaaggtgaagccagacatcgtcgtatcctgcactctagtctgatcgcctcgagtatcgaatatgaactgaacaaatttgttgcaggtgaactgatcatcagcgcatctgagcgaactgatgtcttgttggccagtagtctcgctacaagcaatggtattccactggctggtcttgtcctgactgaacgtaaagcacctaatccacaaattttggatttctgtcagcatgccatcaagcagggcttacctattttacatacacagctcaatacattagaaactgcgcagcgtcttgcagattttggcaatgaaattccagtggatgataccgaacgtgcggaacaagtgactcgctttgtttcgagtcatatcgacactgcatggctcaactcacaaatcaatactggtgtgcagccgcgcttatctccgtctgcatttcgtcatgagttggtgcaaaaatcaattgcagcaaaaaaacgtattgtacttcccgaaggtgatgagcctcggacagtacaagctgcagcaatctgccaatcacgtggtattgctcattgtatcttgcttgcaaaacctgaagctgtggtagaagtagccaaagcacggggtatcgagctgcctgatgatctggaaatcattgatccagatctaattcgtaaccaatacatcacaccgatggttgagctacgtaatggcaaacttaacgaattacaagccaaagaacagctacaagataccgtcgttttgggtaccatgatgctcgcacttgatcaggtggatggtttggtttcaggtgccattcataccacagcaaatacggtacgccctgcatttcaactgattaaaacagcacctgattactcattggtttcatcagttttctttatgttgttgccagatgaagtatatgtatatggtgactgcgcaatcaatccagatccagatgccgaccaactggccgaaattgcaattcagtctgcagattcagctaaagcctttggaattaaccctcgcattgcaatgatcagttattctactggtacttctggtgcaggagcagatgtagagaaagttgccaaagcaactgaaattgccaaacagcgtcgtccagatttattgatcgatggcccattacaatacgatgcagcctcggtagaaagtgtaggccgacaaaaagcaccagactctcaagttgctggacgggcaaacgtctttattttcccagacttaaatacagggaatacgacttataaagcggttcaacgctctgccaatgttgtgagtgtgggtccaatgctgcaaggcttgaataaacccgtaaatgatctgtctcgtggtgcattggtcgatgacattgtgtttaccattgccttaactgcgattcaggccgaacaacaacttgaagccaaagctgctgcgctagcgtcataa

SEQ ID NO: 1515 - DNA, 2145 bp, Acinetobacter sp. RUH2624
atgaatacaattttattaattcctacaggtgaaggggttggtctaacctctgcctgtttaggtatgatttatgcacttgattgtaatgggattaaagcaggctttttaaaaccgttctctcaggtagatcaagaaaatttagaccggaccacctctttatttggccatttatttcaaggtaaaactgttcaatccatttctcatgaaaaactaacccaacgcattgcggctggcgaagtagatgagttacttgaagaagcagtaagtcttcatcgcagtatcgcagcagacaacaatgtgattattgttgaaggcttattaccaaatgggcaagaccattttgccagtgaacttaatgcaagccttgcacaagctctcgatgctgaagtggttttagtcagtacagcagatattcaaaacccacgtaaaacagcagagaaagttgaagctcacttacggcagtttggtggtgcaacctctaaccgaacagcgggtgtactctttatgcgtacacgtgggttgtctgaagaaacagctcaaatacctgtcgcatttgacccgtcgttacgtccaaccgaagacatcgcaaaatttacgacagaactgcaaaaatacaatcgctactttggatcaaacgatttaccaattattggtttagtcccatttagtaataccttaagtgtacctagaactttagacatcgcgaacgtgattgatggtcaatgggtacatcaaggcgaagcgaaaacacgtcgtattttgcactcaagtttaattgcctcaagtattgaatatgaacttaataaattcattgcaggtgagctgattattagcgcatctgaacgtaccgacgttttacttgcaggtagcttggcaaccagtaacggtattccattggcaggcttggtactgaccgaacgtgaagcacctgcccctgagcttttagagttttgccaaagcgcgattaaacaaggcttaccaattttacatacccgtttaaacacactggaaacggcacagcgcttatctgattttggtaatgaaattccaattgatgacactgaacgtgccgagcaagtgactcgttttgtttcaagtcatatcgatgtcgaatggcttaaacaacacagtaataatggagcaacaccacgtctttctccttctgcattccgtcacgaactggtacaaaaatcgattgcagccaaaaaacggattgttcttccagaaggcgatgaaccacgcactattgaagctgctgctatatgtcaggctcgtggtattgcgcattgtattttgttagcaaaaccagatgcggtacaagacgttgcaaaagcacgcggtattgaattaccagcagacttggaaattattgatccggacagcattcgcaaccaatatgttgcacctatggttgaactccgcaaaggcaaactcaatgagttacaagccaaagatcaattacaagacaccgtagttcttggcaccatgatgctggccctagatcatgtagatggtttggtttcaggtgcagttcacaccacggctaacaccgtgcgccctgcttttcagctgattaaaaccgcaccttcttactctttagtttcgtccatattctttatgcttttaccagatgaagtatatgtttacggtgactgtgcaattaacccagaccctacagccgaccaacttgctgaaattgcaattcagtctgctgactctgcaaaagcgtttggaattgacccacgtattgccatgatcagctattcaactggtacgtctggaacaggtgcggatgttgagaaagtacagcaagcgactcaaattgcacagcaacgccgtcctgatttactaattgacggtccactccaatatgatgcagcttccgttgaaagtgtcggacgccaaaaggcaccgaattcacctgtagctggccgtgccaatgtatttattttccctgacttaaatacaggtaacacgacctataaagcagtacaacgtgcagcaaatgtagtcagcgttggaccaatgctgcaaggtctaaacaaaccagtcaatgacttgtctcgtggtgctttagtagatgatattgtctttactattgcattaacagcaattcaggctgaacaacaggctgctgcgaaataa

SEQ ID NO: 1516 - DNA, 2133 bp, Acinetobacter sp. ATCC 27244
atgaatacaattttacttattccaactggcgaaggtgtaggtttaacctcagcctgtctaggcatgatctatgcactagactgtaaaggcattaatgcaggatttttaaaacccttctctcaaattgctgaagcaactgttgatcgcaccacaaccttataccatcatctatttcagcatcatgctgtagaaccgatgacctatgatcgattaacacaattgattgcgctcggtgaaacagatgaattgcttgaagaagcggtggctttacaccgccaaatcgcggcgcatcatgatgtgatcattgttgaagggcttgttccaaatggccaagaccattttgtgagtgaaatcaatgctgccttagcacaagctttagatgctcaagtggtcttggtcagtaccgcagacttgtcagatcctcgcaaaaccgccgaacgaatagatgcacatcttcgacaatttggtggcgctgcttcagcacgtacgactggcattctatttatgcgaaccaaaggtttgcctgaaagtacggctcaaatccctgtcacactcgatccaagcttacgcttaggtgaaaagatagatcgttatgcagtagagttacaacgctataaccgtcatatcggaaccgaggccctacctattattggcttagtgccttttagtaatattttgagcgttccgcgaagtttagacattgccccgattgttaatggaacgtggttacatcaaggtgaagccaaacatcgacgtatattacataccagtttaattgcatctaatattgaatctgaacttcacaaatttgtaccgggtgaactaattattggtgcatctcagcgcgctgatattttacttgctgccagtcttgccagcagtaatggaacaccattggcaggattagttctcacagaaccgtccccacccgcagcaaatgtgcttgagttttgccaaagtgcaatcaaacaaggtctaccagtcttacacacctccctcacaaccttagaagcattgaagaaactcagtcgttttggtaatgaaattccaatcgatgatactgaacgtgcagaacaagttacacgctttgtatcaagccatattgacagtcaatggctagatcaacacacccaaaacaatttacacccgcgcctatctccttcagcattccgttatgagttagtccaaaaatctattactgctaaaaaatgcattgtgctacctgaaggcgacgaacctcgcaccgtacaagcggctgtgatttgtcagaatcgtggtatcgcacaatgtatcttattggcaaaacccgaatctgttgcagaagttgcaaaagctcgtggtattcaattaccgagtgatttaaagatcattgatcctgacactatccgtgaccgctacatcgatccaatggttgaactacgcaaaggtaagttagatgccttacaagccaaagcacaacttcaagataccgttgttcttggtacgatgatgttagccttagatgaggttgacggcttagtttctggtgcgattcatacgacagccaacacagtccgcccagccttccagttgattaagactgcgcctaattattcgttagtttcttctgtgttctttatgctgttaccagatgaagtctatgtgtatggtgattgtgcaattaatccagatccgaatgcagaacaattggccgagattgccattcaatctgctgattctgcaaaagcgtttggtctcgaccctcgtattgcgatgatcagctattcaacaggaacctctggcacaggtgcggatgttgaaaaggtcgctgaagcaactcaaatcgcccaacagcgtcgtcccgatctcctcattgatggacccttacaatacgatgcggcttcagtagaaagtgtcggtcgccaaaaggcacctgattcgcaagtggctggtcgtgccaatgtattcatattccctgatttaaatacgggtaataccacttataaagcagtgcaacgtgctgccaatgtggtcagtgtcggcccaatgctgcaaggtttaaacaaaccagttaatgatttatctcgcggtgctttggtcgatgatatcgtgtttactattgcattaacggcgatacaggcggcgcaacaataa

SEQ ID NO: 1517 - DNA, 2136 bp, Anaeromyxobacter sp. Fw109-5
atgccccgcaccctcctcgtcgcccccgccggccgccaggtcggcgtcaccaccgtctgcctcggcctcgtccgggcgctcgaccgcctcggcgtccgggtcgccttcgcgaagccgatcgccgcccgcggcgagaaccgcgccgcggcgctcctgaagctcggcgcgcgcgtcgattcgcccgagccgatcgcgcgcgcggccgcggagaacctgctcgccaccggggacgaccagacgctcatggagcgcgtggtggcgctgtgcgccagcgccgccgagggcgccgacgtcctggtggtggaggggatggccccggagccgggcatggtgtggtccacgcgcgtcaacgcgctcatgctcaaggccctcgacgcggagctcgtgatcgtgggggcgccccggggcgagacgcccgcggagctcgcgaacgcggtgtccatcgccgcccgcggcctcggcgccgacgtggacgggcgcggggtcgggtgcatcctgaaccgggtcaccgcgggcgcggcgagcgcgggtgaggcgcgcacgcactggttcgacgccgccgtggaggccgaggacgtgccgccgtccgtgctcgacggctacgccgacgcgctgcgcgccgagaagctccggcccatcgggatcgtcccctcccgcagcgacctcgccgccccgcgcgtgaaggacctcgcgggcgcgctgggcgcgaaggtgctccgcgccggcgatcaggaccggcgccgcatccgcagcgtcgccctgtgcgcgatgagcgtgcccggctccatcaaggtcttccgccccgggaccctcatcatcacccccggcgaccggagcgacatcgtggtggccgcgtccctggcggtgctgaacgggatgccgctcgccgggctgctgctcaccggcggggtggagcccgaggagcacgtgttcgccatgtgcgagcgggcgctcgagaccggcctgccgatcctggccgtgaaggagggcagctacgccgccgccagcgccgtcgccgcgatgaacctccagatcccgccggacgacgtggagcgggtcgagcgcgtcatgaacaccgtcgccgaccggctcgaccgcgagtggctggagggcctcggccgcacccggcgcgtgcgccggctgtcgcccccggcgttccggcaccggctggtcgagtcggcgcgcgcggcggacaagcgcatcgtgctccccgagggcaccgagccgcgcaccatcgccgccgcctccatcgtgcaggagcgcgggatcgcgcgctgcgtgctgctcggcaaccccgacgagatccgcgacgtggcccggaagcagggggtgagcctccccgcctcgctcgagctcctcgatccggcggtgatcgcccctcggtacgtggagcccctcgtcgagcgccgccgcagcaaggggatgacgccggagatggcgcggagcgagctcggcgacaccatcatggtgggcaccatgatgatggcgctcgacgaggcggacggcctggtgtccggggccctccacacgacggcgcacaccatccggccggcgctgcagatcatcaagacggtgcccggctgcgacctcgtgtcgagcgtgttcttcatgtgcctgccggagcaggtgctcgtcttcggcgactgcgccgtgaacccgaaccccaccgccgagcagctcgccgacatcgccatccagagcgccgactccgcccgcgcgttcggcatcgacccccgcgtggcgatgctctcctactccaccggcacgagcggcaccggcgcggacgtggagaaggtgaagaaggcgaccgagctcgcgcgggcgcagcgccccgacctcgccgtcgacggccccctccagtacgacgccgccatcgtccccgacgtcgggcggcagaaggcgccgaagtccgacgtggccggccgggcgaccgtgttcgtgttcccggacctcaacaccggcaacgtcacctacaaggcggtgcagcgcagcgccaacgtggtgagcatcggccccatgctgcaggggctcgcgaagccggtgaacgacctgagccgcggctgcctcgtcgaggacatcgtcttcaccatcaccctcaccgccatccaggcgcagcagcgcgcggcccagcgctga

SEQ ID NO: 1518 - DNA, 2145 bp, Anaeromyxobacter dehalogenans 2CP-C
atggcccacgtcctcctcctcgcgccggccggacgccaggtcggcctcaccaccgcctgcctcgggctggtgcgcgccctggatcgccagggcgtgcgcgtcgccttcgcgaagcccatcgccgcgcgcggcgaggaccgcgtctcggccctggtccggctcgggtcgagcctccggccgccggacccgatccctcgcgccgaggccgacgcgctgctcgccgccggggacgaccagacgctgatggagcgggtggtggcgctctgcgcgggcgccgccgagggcgcggacgtcctggtggtcgccggcatgtggcccgagcccgggatggtgcactcgacgcgggtcaacgcgctcatgctgaaggcgctcgacgccgagctggtcctggtcggctctccccgcggcgagacgccggcggagctggcggacgcgatggcgatcgcggcgcgcgggctcggcgggttcggcgacggcgagccggtgagctgcttcctgaaccgcgtcgcccccccggcgccggccgcccgcgtgggcgagtcccggcccatctggctggaggcgggcgaggagggcgagctcccggcggcggagatcgaggcctaccgcgcggcgctggaggcggagcggctccggcccatcgcggcagtgccgtcgcgcggcgacctcgccgccccgcgcgtgaaggacctcgccgaggcgatcggcgcgcgggtcgtccgctccggcgacctcgagggccggcgcatccggcacgtggcgctgtgcgcgatggcggtgccggggtcgatcaagacgttccggcccggcacgctcgtcatcacccccggcgaccggagcgacatcctgctcgccgcggcgctggccgtgctgaacggcgtgccgctcgccgcggtgctgctcaccggcggcgtcgagcccgagccccacgtgttcgagatgtgcgactccgcgctccgggccgggctgccggtcctcgccgtggaccagggcagctacgccgccgcgaccgcggtggcgggcatgaacctgcaggtgccccccgacgacgcggtgcgggtggagcgggtgatgacggcggtggccgatctcatcgaccccgcctggctgcggtcccgcgccgcgaccacccgcgtccggcgcctctcgccgcccgcgttccggcagcggctggtggaggcggcgcgcgccgcgaacaagcggatcgtcctgccagagggcgccgagccgcgcaccgtggcggcggccgccatcgcgcaggagcgcgggatcgcgcgctgcgtgctgctcggcgacgccgacgaggtccacgaggtcgcgcgccggcagggcgtcacgctgccgccctcgatcgagatcgtcgatccggcccgggtcgcgccctggtacgtggcgccgctggtcgagcggcgcgcggccaaggggatgaccgcggcgcaggccgcccaggaactgggcgacgcggtgatggtcggcaccatgatgatggcgctcgacgaggcggacgggctcgtctccggcgcgctccacaccaccgcgcacaccatccggccggccctccagatcgtgaagacggtgcccggctgcaacctggtgtcgagcgtgttcttcatgtgcctgccggagcaggtgctggtgttcggcgactgcgccgtgaacccgacgcccaccgccgagcagctcgccgacatcgcggtccagagcgccgactcggccgccgcgttcggcatcgagccgcgcgtggccatgctgtcctactcgaccggcacgagcggcgcgggcgaggaggtcgagaaggtgaagcgcgcgaccgagctcgcgcgcgcggcgcggccggacctcgccatcgacgggccgctgcagtacgacgcggcggtcatgcccgacgtggcgcgccagaaggcgcccaggtcgagcgtggccggccgcgcgacggtgttcgtgttcccggacctcaacaccgggaacgtcacctacaaggccgtgcagcggagcgcgaacgtggtcagcatcgggccgatgctgcaggggctcgccaggccggtgaacgacctgagccgcgggtgcctggtcgaggacatcgtgttcaccatcgcgctcacggccatccaggccaggcagctggcggcgcgccggtcgcgctga

SEQ ID NO: 1519 - DNA, 2139 bp, Mannheimia succiniciproducens MBEL55E
atgtcacgtacaattatccttattccaatcagcgcaggcgtaggtttaacaagtgtaagtctcgggcttattcgtgcattagaacaaaaagggactaaaatcggtttcatgaagccgatttcacaacctcgttccggtgaagatatgcttgatagaacaacctcaattgttcgcacaagcacgacaatcgaaactaccgaacctgttatgctaagtgaggctgaaaatttaatcggtcaaaaccaaacagacgttttattagaaaaaattgttgcccagcatcaacaaatcagcaaagacaatgatatcgtgatcgtcgaaggtttaattccttcccgcaaaaactcttatgctaacagtgtaaactacgatatcgcgcaagcactggatgccgaaatcattttagtttccgcgcctgcaaccgaaacgcccgctcaattaaaagagcgcgttgaagcggccgccgcctcattcggcggtaaaagcaatcctaatttacttggtgtggttattaataaatttaatgcgccggttgatgaatcgggtcgtacccgtccggatttaacggaaattttcgattcattccagcatagtcacaataatatcaaagaaatttacaaactatttgaaaacagcccgattaaagtattggcttgtattccttggtctgcagatttaattgctacccgtgcgattgatttggtaaaacatttgggcgcttctattcttaacgaaggcgatatgaaccgtcgtatccgcagtatcactttctgcgcaagaacgctgcctaatatgattgaacacttcaaagcgggcagcttgctggtagtttccgccgaccgccctgaaattttaaccgcagccgcgttagccgctactacaggtattgaacttggcggtattttattaaccggcggttacaaaatagattgcgaaatcaaaaaattatgtaacccgacattcgaaaataccaaattaccggtattccgtattgaaggtaacacttggcaaacggctttaagcttacagagttttaatcttgaagtaccggttgacgataaagaacgtatcgaaaatatcaaacaatataccagcggacaatttgatgcggatttcattcattcactggcttccgcttccgtgcgtgcccgtcgtttatctccgccggcattccgttatcaattaaccgagttagcgcgtgcggcgaaaaaacgtattgttttgcctgaaggtgacgaacctcgtacgattaaagcggcggtactttgtgcagaacgcggtattgcggaatgcgtattattggcgaaacctgaagacgtaaaacgtgttgccgattctcaaggcgtgaaattaggtaacggaattaccgttatcgatcccgcttcagttcgtgaaaactatgtcgctcgtttagtagaactgcgtaaagcaaaaggtatgactgaaatggcagcccgcgaacaactggaagacaccgttgtattaggtacaatgatgttagaagccggcgaagtagacggtttggtatccggtgcggtccatactactgcaaatacgattcgtccgccgatgcaaattatcaaaaccgctcccggtagttcgattatttcatcgatcttcttcatgttgttaccggatcaagtattagtatatggtgactgtgcggttaacccggatccgactgcggaacaattagcggaaattgctattcaatctgcggaatcggcgaaatccttcggtattgaccctcgcgttgctatgatctcttactcaaccggcacatcaggctccggcgcagatgttgaaaaagtgaaagaagcgactcgtatcgcacaggaaaaacgccctgatttattaatcgacggtccgttacaatatgatgccgccgtaatggaagatgttgcgcgttctaaagcgccgaattctaaagtagccggtaaagcgaccgtatttgtattccctgacttaaatacgggtaatacgacttataaagcggttcaacgttctgccgatttagtatcaatcggtccgatgttacaaggtatgcgtaaaccggtgaacgacctttcccgcggtgcattggttgacgatatcgtctataccatcgcattaacggcaattcaggcgacacaatgctaa

SEQ ID NO: 1520 - DNA, 2142 bp, Actinobacillus succinogenes 130Z
atgtctcgtacatttattcttatccctatcagcggcggcgttggtttaaccagcgtcagtctcggtttaatccgttccctcgaacaaaaaggcgccaaaatcggctttatgaaaccgatctcccaaccaagcaccggcgaagacaaaatcgatcgtaccacttcaatcgttcgcaccagtacgcagcttgaaacagccgaaccggtaatgttgagcgtggcggagaatctgatcggtcaaaaccaaaccgatgtcctgttggaaaccatcgttgcggcacatcaggaattaagcaaaaataacgaaatcgttattgtcgaaggtttaatccctaaccgcaagcacagttatgccaatagcattaactacgaaatcgctcaggcacttgatgcagaaattattttagtggcggcgccaagtacggaaacgccggcgcaactcaaagaacgcgtagaagcttccgcttcgttgttcggcggcaaaaacaacccgaatctgttaggcgtcgtaatcaataaattcaatgcaccggttgacgaatccggtcgtacccgtcctgatttaaccgaaattttcgattcattccaacacagccataataattcggcggaagtgttcaaactgttcgaacaaagcccgattaaggttttggcatgtatcccatggtctgccgatttagtggcgacccgcgtaatcgatttagtcaaacacttaggtgcggcgatcattaacgaaggtgaaatgaaaacccgccgtatccgcggtattacattctgtgcccgttcgttacatcacatggtggaacatttccatgcaggcgatttgttagtgacttccgccgaccgtgcggacgttttggccgccgcagcattagccgtgactaacggcattgaattaggcggtatcttactaaccggcggttataaaatcgataacgagatcaataaactatgccaacgcgcctttgaaactaccggcttacctatcttccgcatcgaaggtaacacctggcaaaccgcattaagtttacaaagcttcaaccttgaagtaccggtcgacgataaaatccgtattgaaaacattaaagaatataccagccgtcaattcgacgcggaatttattcatcaaattgccggcacatcagcccgcgtacgccgtttatcaccgccggctttccgctatcaattaaccgaattggcccgtgctgcgaaaaaacgtattgttttacctgaaggcgacgaaccgcgtaccgttaaagcggcggcgctgtgtgcagaacgcggcattgccgattgcgtattgctagccaatcctgaagatgtaaaacgcgtagcttcagcccaaggggtcagcttagataaaggtattactgttatcgatcctgccactgtacgcgaaaactatgtggcgcgtttggtcgaattacgtaaagcgaaaggtatgaccgaagaagcggcacgcgaacaattggaagacaacgtggtgttaggcaccatgatgttggaagccaacgaagtggacggtttggtttcaggtgcggtacacacgacggcaaacaccattcgtccgccgatgcaaatcatcaaaaccgcaccgggcagctcgatcgtttcctcaatcttcttcatgttgttgccggatcaagtattggtgtacggcgactgtgcggtaaatccggatccgacagcggaacaattggcggaaatcgccattcaatccgccgattccgccaaagccttcggtattgatccgaaagtagcgatgatttcctactcaaccggtacttccggtgccggtgcggacgttgaaaaagtgaaagaagcaacccgtatcgcgcaggaaaaacgtcctgacctactgattgacggtccgttacaatacgacgcggcagttatggcggacgtggcgaaatccaaagcgcctaattcgccggttgcaggtaaagccaccgtattcgtcttcccggatttgaataccggcaacaccacttataaggcggtacaacgttctgcggatttagtgtctatcggcccaatgctgcaaggtatgcgtaaaccggtaaatgacttgtcccgcggcgcattagtggacgatatcgtttataccattgcgttaaccgctattcaggctacgcaagcttaa

SEQ ID NO: 1521 - DNA, 2136 bp, Aggregatibacter aphrophilus NJ8700
atgtcccgtactatcattttaattccgattagcaccggcgtaggtttaaccagcgtaagtcttggtttaatcaacgcacttgaacaaaaaggcgcaaaagtcggtttcatgaaacctatttcccagccaaataccggtgaagacgttatcgatcgcaccacgtctattgtacgtagtagcacggccttagaaacagccgagccgtttatgttaagcgtggcagaatccctgatcggtcagaaccaatctgatgtgttactcgaaaaaattgttgaaaatcaccaaagactgtctaaaaacaatgaaattgttatcgtggaaggcttgattccaactcgtaaacattccttcgccaacagcattaactacgaaattgctcaagcgcttgatgcggaaatcgtgttagttgcagcacctgccacagaaaccccagcgcagttaaaagaacgtgttgaggctgcagcgtctctattcggcggtaaaggcaataaaaacctactgggtgttatcgtcaataaatttaacgccccaattgatgaatccggcagaacccgtcctgatttaagcgaaattttcgattccttccaacacagccacaacagcgaatccgaattggttaaattattcgctcaaagccaaattaaattattagcttgcattccatggtccgctgatctcatcgccacccgagcgattgatttaatcaaacatttaggcgcatccattctcaatgaaggcgatgtcaaccgtcgaattcgtggtatcactttctgcgcaagaagcctaccaaacatggttgaacacttccgtgcaggtagtttattagtggtttctgccgaccgtcctgatgttatcgtggcagcagcccttgcagtatccaacggtattgaaatcggcggtttattattaaccggcggctataaattagatccgcaaatcaaaaaactttgccaacacgtttttgaaagcaaaaaattaccggtcttccgcattgaaggcaacacatggcaaaccgcattaaacctacaaagtttcaatcttgaagtaccggttgacgataaagaacgcattgaaaatatcaaacgctacaccagtgaaaaattagatgcctctttcgttaacggtttggtggaagcctccggtcgcttacgtcgtttatcaccaccggcgttccgtttccaattaaccgaactcgcccgtgcagctaacaaacgcattgtgttaccggaaggtgacgaaccgcgtactatcaaagctgctattctttgtgccgagcgtggcattgcagaatgcgtgctgttggcaaaaccggatgatgttaaacgcgttgccgaatcacaaggcgtaaaattagtcaaaggcattaccgtgatcgacccagccagcgtgcgtgaaaactacgttgcccgtttagtggaattgcgtaaagccaaaggcatgaccgaaaccatggcgcgcgagcaattggaagataatgtcgtacttggcaccatgatgctggaagccaacgaagtagacggtttggtttccggcgcggttcacaccactgccaacactattcgcccaccaatgcaaattatcaaaacagcaccgggtagttccattatttcttccatcttcttcatgttgctgccggatcaagtgcttgtttacggtgactgtgcggtgaatccggatccaacagcagaacaattagcggaaatcgccattcaatctgccgaatccgccaaatccttcggcatcgatccaaaagtggcaatgatttcctactccaccggtacatcaggtagcggtgctgacgtagaaaaagtgaaagaagcgacccgcattgcgaaagaaaaacgtcctgatttactcattgatggtccattacaatacgatgcggcggtaatggaagatgtggcacgttctaaagcaccgaattctccggttgccggtcaagccaccgtattcatcttccctgatttgaataccggtaacaccacctacaaagcggttcaacgttctgccgaccttgtttctatcggtccgatgttacaaggtatgcgcaaaccggtgaacgacttatcccgtggcgcattagtagatgacattgtgtacaccattgctttaactgcaattcaagcaacacaataa

SEQ ID NO: 1522 - DNA, 2136 bp, Haemophilus influenzae 3655
atgtctcgcacgattattcttatccctgtaagtacaggcgtgggtttaactagcattagtcttggattaatccactctctcgaacaaaaaggcacaaaagttgcttttatgaaaccagtttctcaaccaagcactggcgaagataaattggatcgcacaacttctattattcgcactagcactagccttgaaactgccgaaccttttatgttaagcgtggcagaatcattaattggtcaaaatcagtctgacgtattgttagaaaaaattgtagctaaccaccaacaattaaccaaaaataatgacatcgttgtagttgaaggcttaatacccacaagaaaacacggttacgcaaacagtatcaactatgaaattgcacaagcattagatgcggaaatcgtattagttgcagcacctgcaactgaaacgccaaccgaattaaaagatcgcgtagaagctgcagcctctctatttggtggtaaaaacaatccaaatcttttaggtgttgttgtaaacaaattcaatgcacctgttgatgaatcaggtcgtactcgtccagatcttgctgaaatttttgattcattccaacacaatcatattagcgaaacagaagtaaacaagttatttgcaggtagtgctatcaagttattagcttgtgtgccttggaatgcaaatttaatcgcgacacgagcaattgacttagtcaaacatttaggtgcatcaatcattaatgaaggagaaatcaatcgccgtatccgtggcatcactttctgtgcaagaagtttatcaaatatgatagaacatttccgcgcaggtagcttattggttgcctctgctgaccgtcctgatgtaattgttgctgcttcacttgctgctgcaaacggtattgaaatcggcggtattttattaacaggcggctacaaaattgatgctcaaattaataaactttgccgtccaacttttgaaaaagcgaaattaccgatcttccgtattgaaggcaatacttggcaaactgcattaagtttacaaagttttaatcttgaagtgcctgttgatgacaaagaacgtattgaaaatattaaacaatacattagccaacactttaatgctgactttatcaataatttagttgcagattccagccgtttacctcgcttatccccacctgcattccgtttccaattaactgaacttgctcgtgcggcgaaaaaacgtattgtgcttcctgaaggcgatgaacctcgtacaatcaaagcagccgtactttgtgcagaacgtggcattgcggaatgtgtgcttttagcagatcctgcatccgttcaacgagttgcagaagcacaaggtgttaaattaggtaaaggtattacaatcatcaatcctgctgacgttcgtgaaaactatgttgatcgtttagttgaattacgtaaagcaaaaggtatgaccgaaactgcggctcgtgagcaattagaagacactgtggtacttggcacaatgatgctagaagcaaatgaggtagatggtttagtatctggcgctgtccacaccactgcaaacaccattcgaccaccaatgcaaatcatcaaaactgcaccgggtagttcgattgtttcttctatcttctttatgctattaccagatcaagtgcttgtttatggtgactgtgcggtaaacccagatccaactgcagaacaacttgctgaaattgcaattcaatcagcagattctgcgaaagcatttggtattgatccaaaagtcgcgatgatttcttactcaacaggtacatctggtagcggtgctgatgtagaaaaagtgaaagaagcaactcgtattgcgaaagaaaaacgccctgatttattaatcgatggcccattacaatacgatgcggctgtgatggaagatgtagctcgctctaaagcaccaaattcaccagtagcaggtaaagcaacggtatttgtattccctgacttaaatactggtaacacgacttacaaagcagtacaacgttctgcagatttagtgtctattggcccaatgcttcaaggtatgcgcaaaccagtcaatgacttatctcgtggtgccttagttgatgatattgtgtacacaattgccttaaccgcaattcaagcaacacaataa

SEQ ID NO: 1523 - DNA, 2139 bp, Haemophilus somnus 129PT
atgtctcgtacaattatccttattcctattagcactggtgttggtttaaccagtgtaagtttaggtttaatccacgctcttgagcaaaaaggggcaaaaatcggtttcatgaagccaatttcgcaaccaagtaccgatgaagataaattagaccgcactacttcaattgtgcgtaccagtacaacacttgaaacagccgaaccgtttatgctaagtgtggctgaaaatctaatcggtcaaaatcaatccgatgtgttactggaaaagattgttgaaaatcatcaacaactagctaaaaataatgaattgattattgttgaaggcttagttccaactcgcaagcatggctatgcaaacagtatcaactacgaaattgcaaaggcgttagatgctgaaatcgtattagttgcagcacctgcaacagaaacgccggcagagttaaaagaacgcattgaagcagcggcctcccaatttggcggaaaaaataatccaaacttacttggtgtcataattaataaatttaatgcaccaattgatgaatccggacgtactcgtccagacctaagtgaaatttttgatgcttaccaacataaacaaaataaccttaatgaggtttacaagctatttgaaaaaagccctattaaagtattagcttgcgttccgtggaatgcggagcttattgcaactcgtgctattgatttggtcaatcatttaggtgcttctattctacatgagggtgatattaaaactcgtcgtattcgtagtattactttctgtgctcgttcattacaaaatatggttgagcatttcaaaacaggtagtctgttagttacctccgctgatcgtcctgatgtcctaactgcctccgcacttgctgcgactaacgggatcgagctaggtggtattttactcacagggggttacaaaattgacaatcaaattaaaaaactatgccaaccagtatttgaaaataccggcttacctatttttcgaattgaaggtaatacatggcaaagtgcattggctctacaaagcttcaaccttgaagtacctgttgatgataaagaacgcatcgaaaacattaaacaatacacaagccaacaatttaaatcttcatttattgaaaatttagttgccgcctcaactcgtcctcgtcgtttatctcctcctgcattccgttttcaattaactgagttagctcgtgcagccaaaaaacgaatagtattacctgagggagatgaacctcgtacagttaaagctgctagtctttgtgcagaacgtggtattgcagaatgtatcttattagcaaatcctgatgatgttaaacgtgttgctgatgctcaaggcgttgtattaggaaaaggtattacaataattgatcctgtctctgtacgtgaaaattatgtagaccgtttagtagaattacgtaaagccaaaggtatgactgaaacgtctgcacgagagcaattagaagataccgtcgtattaggcactatgatgcttgaggctaacgaagtcgatggacttgtttcaggtgcgatacatacaacagcgaatactattcgtccaccgatgcaaatcattaaaacagcacctggtaactcaattgtttcttcaattttctttatgttattacctgaccaagtacttgtttatggcgactgtgcagttaatcctgatccaactgccgaacaattggcagagattgcaattcaatctgctgattccgcaaaagcattcggtattgatccaaaagtggcgatgatctcttactcaacaggaacgtcaggttccggtgctgatgttgagaaagtaaaagaagcaactcgtattgcccaagaaaaacgcccagatttattaatagatggcccattacaatatgatgcggcagtaatggaagatgtagcaaaatctaaagcaccaaattctccggttgccggtaaagcgacagtatttgtcttcccagatctcaataccggaaatacaacctataaagcagtacaacgctcagcagatttagtatctattggtccgatgttacaaggtatgcgtaagccggtcaatgacctatctcgtggagcattggttgatgatattgtgtatactattgcattaactgcaattcaagcgacacaataa

SEQ ID NO: 1524 - DNA, 2139 bp, Pasteurella multocida subsp. multocida str. Pm70
atgtcacgtacaattatccttatcccgattagtgctggtgtaggcttaaccagtgtcagcttaggtttaacacatgcactggagcaaaaaggggcgaaagtcggctttatgaaaccaatttctcagccgaactcaggtgaagatatgattgatcgcacaacatcaattattcgcaccagtaccaccattgaaaccagtgaaccgtttatgttaagtgtagcggaatcactaatcggtcaaaatcaatctgatgtggtactagaaaaaattgttgaaaatcatcaacaactcgccaaaaacaatgaaattgtcgtggtggaaggtttaatccctacgcgtaagcattcttatgccaatagcattaactatgaaattgctcaagcacttgatgcagaaatcattcttgttgcagcaccagcgacggaaacaccagcagaactcaaagaacgcatcaaagccgcagcctcattatttggcagcaaaaataaccctaatttacttggtgttgtgatcaataaatttaatgcgccgattgatgaatctggtcgtactcgccctgacttggcagaaatttttgattctttccaacacacacaaaatcaagtatctgagatttatcatttatttgagaaaagcccaattaaaatcttggcatgtattccttggagcgcagaattaattgcgactcgtgccattgatttagccaaacatttaggtgctgccattattcatgaaggcgctatcaatgaacgtcgcattcgtggcatcactttctgtgcacgtaatttgaccaatatggtggaacatttccgtgttggaagtttacttgtcacttccgcagatcgtcctgatgtgatcgtcgcagcggcattatctgccatgaatggcgttgaaattgcaggtgttttattaaccggtggttacaaaattgatgcacaaatcaagaaactctgtcaacacgcgatcgaaagtacaggtttaccagtcttccgtgtcgaaggcaacacttggcaaactgcactggcactacaaagttttaacctcgaagtgcctgttgatgataaagaacgtatcgaaaaaattaaacattatattagcgacctactcgacagcaattttatcgattcattagcggcggcctcttctcgtttacgtcgtttatcgccacctgctttccgtttccaattaaccgaattagcacgtcaagcgcaaaaacgcattgtattgcctgaaggggatgaaccacgtacagtaaaagctgctgccttatgtgcagagcgtggtatcgctgaatgtgtgttattagctacaccagaatccgtcatgcgtgttgccgaagcacaaggcatacaattaggcaaagggattacgattattgatcctgctacagtgcgtgaaaactatgttgcacgtttagtggaattgcgtaaaaacaaaggcatgaccgaagattctgcacgtgaacaattagaagacaatgtggtacttggtacaatgatgttagaagcgaacgaagtagatggtttagtctctggtgccgtacatacgacagccaatactattcgtccgccgatgcaaatcatcaaaactgcaccgggtaattcgattgtgtcttcaatcttcttcatgttattacctgatcaagtcttggtttatggtgactgcgcagtcaacccagatccaacagcagaacaattagcagaaatcgcgattcaatccgcagactcagccaaagcctttggtattgatccaaaagtggcgatgatctcttactcaactggtacttctggtagtggtgcagatgtagagaaagtgaaagaagccactcgtctggcacaagaaaaacgtccagatttaatcatcgacggtccattacaatatgatgcggcagtgatggaagatgtagcgcgttctaaagcaccaaattcaccagtggcaggtaaagcgacggtctttattttccctgatttgaataccggtaataccacttataaagcggtacaacgctctgctgaccttgtgtctattggaccgatgttacaaggtatgcgtaaaccagtgaatgatttatcacgtggtgcgttagtggacgatatcgtgtacacaattgccttaactgcaattcaagcaacacaataa

SEQ ID NO: 1525 - DNA, 2139 bp, Pasteurella dagmatis ATCC 43325
atgtcccgtacaattatccttattccaatcagctctggtgttggcttaactagcatcagtcttggtttaattcactcattagagcaaaaaggcgcaaaaattggttttatgaagccaatttctcaaccatactctggtgaggatactattgatcgtacaacatctatcgtacgtacaaacacctcattagatacagcagagccatttatgttaagcgtggctgaatcattaattggtcaaaatcaatctgatgttgtattagaaaaaatcgttgaaaatcatcaacaattagcaaaaaataatgacatcattgtcgttgaaggtttaatacctactcgtaaacacagctatgcgaatagtattaactatgaaattgcacaagcactcgatgcggaaatcattttagttgctgcgcctgcaactgaaacgcctgcggaattaaaagaacgcatcaaagcagctgcatcattattcggtggcaagaataaccctaacttattaggtgttgtaatcaataagttcaatgcaccaatcgatgaatccggtcgtactcgcccagatctcgcagaaattttcgattcattccaacatacacaaaaccaagtttctgaaatttatcacttatttgagaaaagtccaattaaggtacttgcatgtatcccttggagtgctgaattaattgcaacacgtgctagcgacttagcaaaacatttgggtgccgctattattcatgaaggtttaatcaacgaacgtcgtattcgtggtattacattctgtgcacgtaacttaaccaatatggtagatcacttccgtgtaggtagcctactagttacttctgctgaccgtcctgatgttcttgttgctgcatcattagcagcaatgaacggagtggaaattgcgggtgtacttttaactggcggttataaaattgatgctcaaatcaagaaattatgtgaacatgctatcgaaagcacaggtttaccaatattccgagttgaaggtaatacatggcaaactgcattagcattacaaagcttcaatttagaagtaccagtggacgataaagaacgtatcgaaaaaatcaaaaactatgtgagcgaacaaattgatactcaattcattgattctttagttgcggcatcttcacgtttacgtcgtttatctccaccagccttccgtttccaattaacggaattggctcgccaagcgaaaaaacgcattgtattaccagaaggtgatgaacctcgtacagtgaaagcggctgcgctttgtgcagaacgaggtattgcagaatgtgtactattagcaaacccagattctgtaatgcgtgttgctgaagcccaaggtgttcaattaggtaaaggtatcacaatcattgatcctgtaactgtacgtgaaaactacgttgctcgccttgttgaattacgtaaaaacaaaggtatgactgaagattcagcgcgtgagcaattagaagatactgtagtattaggtacaatgatgttagaagcaaacgaagttgatggcttagtatcaggtgctgttcacacaactgcaaatactatccgtccaccaatgcaaatcatcaaaactgcgcctggtagctcgattgtttcttcaatcttctttatgttattaccagatcaagtattagtttacggagactgtgctgttaacccagatccaacagcagaacaattagctgaaatcgcaattcaatcagcagattctgcaaaagcatttggcattgatccaaaagtagcgatgatctcttactcaactggtacatctggtagcggtgctgatgttgagaaagtgaaagaagcgactcgtttagcaaaagaaaaacgcccagatcttatcatcgatggtccattacaatatgatgcagcagtgatggaagatgtggctcgttcaaaagcaccgaactcacctgttgcaggtaaagcaactgtatttgtcttccctgacttaaatacaggtaataccacttataaagcggtacaacgttctgcagacttagtgtctatcggaccgatgttacaaggtatgcgtaaaccagtgaacgacttatctcgtggtgcattagttgatgacattgtgtacacaattgcgttaacagcaatccaagcaacacaataa

SEQ ID NO: 1526 - DNA, 2139 bp, Actinobacillus pleuropneumoniae serovar 1 str. 4074
atgtccagaactattatcttaatcccaacaacaaccggtgtcggcttaacgagtgttagtctcggtttagtacatgctttggaacaaaaaggttctaaagtcggctttttaaaaccaatcgcgcaacctatcagcggcgaagatacgttagaccgctctacttcgattattcgttcggcgcaaacgacagaagtcggcgagccgtttatgttgagcgaggcggaagcgttaatcggtcaaaaccaatcggacgttttattagaaaaagtggttgaacgtcatcaacaactcagcaaaaacaatgaaatcgttgttgttgaaggtttaatccctactcgtaaaaattcatacgctaacagtgtaaactatgatattgctcaagcattagatgcggaaattatcttagttgccgcaccgggttcggataaaccgacccaattaaaagagcgtgtagaagcggccgcttcagagttcggcggtcgtcacaaccctaacttattaggcgtaattatcaataaatttaacgcaccggttgatgagtcgggtcgtactcgtccggacttaaccgaaattttcgattctttccaacacagcacacaaaatattgcggaagttgaagcgttatttgcaaaaagtccgattaaattactcgcttgtgttgagtggaaatccgatttaattgcaacacgtgctatcgacttagcgaaacacttacgtgcggctattatcaatgaaggtgaattacaaactcgtcgtatccgtggcgtaacattctgtgcgcgtagtcttccgcatatggttgatcattttaaagcgggcagcttattagtgacctctgcagaccgtccggaagtattggttgcagcgtctttagcggtaatgaacggtgtggaaatcggcgcaatcttattaaccggcggctataaaatcgaaacaccgattgcaaaactttgccaacaagcatttgaatccggcgttccggtgttccgtgtagaaggtaatacatggcaaactgcacttaacttacaaagtttcagcttagaagtgcctgcggatgataaagaacgtatttcatcgattaaagaatatgttgcaagccaatttaaccacggtttcattgatgaaatttctaaagcggcaacacgcgctcgtcgtttatctccggcagcattccgttatcaattaaccgaatatgcacgtcaagcgaaaaaacgtatcgtattaccggaaggtgacgaacctcgtaccgttaaagcggcggcattatgtgccgaacgcggtatcgcggaatgtgtgcttttagcaaatccgacggacgttcaacgtgtagcggaatctcaaggtgtggtattaggtaaaggtattacgattatcaatcctgaagaagtacgtgaaaactatgtggctcgtttagtcgagttacgtaaaaataaaggtatgacggaagtggttgcgcgtgagcaattaacggatacggtagtactcggtacaatgatgttagaagccggcgaagtggacggtttagtatcgggtgcggtacatactacggcaaatacgattcgtccgccgatgcaaatcatcaaaaccgcaccgggtagctcgattgtttcttcaatcttctttatgctattaccggatcaagtgcttgtgtacggtgactgtgcggtgaacccggatccgacggcagaacaattagctgaaattgcaattcaatctgcggaatcggcgaaagcgttcggtatcgacccgcgtgtggcaatgatttcttactcaaccggtacttcaggttccggtgcggatgttgagaaagtgaaagaagcgactcgtatcgcacaagaaaaacgccctgatttaatcattgacggtccgttacaatatgatgcggcggtaatggaagatgttgcacgctctaaagcaccgaactctccggtagcgggtaaagcgacagtattcgtattccctgacttaaataccggtaatacgacctataaagcggtacaacgttctgcggatttagtgtctatcggcccaatgcttcaaggtatgcgtaaaccggtgaatgacctttctcgcggtgcgttagttgatgatatcgtttatacgatcgcattaaccgcaatccaagcgacacaaggttaa

SEQ ID NO: 1527 - DNA, 2139 bp, Actinobacillus minor NM305
atgtctagaactattattcttatccctacaacaacgggcgtgggtttgaccagtgttagtcttggtcttgttcacgcattggaacaaaaaggtactaaagttggtttcttaaaaccaattgctcagccaatcactggcgaagataccttagaccgctctacttcaatcattaaagcatctcaaacgactgaaattggtgagccatttatgttaagtgaggctgaaacgcttatcggtcaaaatcaaacagatgttttattagaaaaaatcgttgcacgccaccaagcattagcaaaaaacaacgaaatcattgttgtggaaggtttaattccaacccgtaaaaactcttatgcgaacagcattaactatgaaatggctcaagcattagatgctgagatcgtattagtagcagcacctggttcagataaaccggctcaattaaaagagcgtgttgaagcagcagcatcagaatttggtggtcgtcataaccctaacctacttggtgttgtgatcaataaattcaatgcgccggttgatgaatctggtcgcactcgcccagatttaacagaaattttcgactcattccaacacagcacacaaaatgttgctgaggttgaagcattatttgcaaaaagcccaattaaactactcgcttgtgttgaatggaaagcagatcttattgcaacacgtgccgtagacttagcaaaacatttacatgctgcaatcatcaatgaaggtgaacttaatactcgccgtattcgtggtgtaagtttctgtgcaagaagcttaccacatatggttgatcactttagagcaggtaacttattagttacttcagcagaccgcccagaagtattagttgcagcttcattagctgttatgaatggtgtagaaatcggtgcaattttattaaccggtggttataaaattgaaaactcaattgctaaactttgccaacaagcatttgaaaccggtgtaccggtattccgtgtagaaggtaacacatggcaaactgcacttaacctccaaagcttcagtttagaagtaccggtagatgacaaagaacgtatcttagcaattaaagaatacgttgcaagccaattaaattcaggctttatcgaagaggtttctaaaggtgcaacacgtgctcgccgcttatcgccagcagcattccgttatcaattaacagaatttgctcgttcagcgaaaaaacgtatcgtattaccagaaggtgacgaaccacgtacagtgaaagctgctgcattatgtgcagaacgtggtattgcagaatgtgtacttttagcaaacccagttgatgtacaacgtgttgcagaagcacaaggcgtagttttaggtaaaggtattaccattattaatcctgcggatgtccgtgaaaattacgttgctcgtttagttgagttacgtaaagcaaaaggtatgacggaagagtctgctcgtgagcaattagaagacactgttgtacttggtactatgatgttagaagcaaacgaagttgatggcttagtttcaggtgccgttcacaccacagcgaatacaattcgtccaccaatgcaaattatcaaaacagcaccaggtagctcaattgtatcttctatcttctttatgttattaccagaccaagtgcttgtatatggtgactgtgcggtaaacccagatccaaatgcagaacaattagctgaaatcgcaattcaatctgcagattctgcaaaagcctttggtattgagcctcgtgttgcaatgatctcttactcaaccggtacatcaggttctggtgcagatgtagagaaagtgaaagaagcaacacgtattgcacaagaaaaacgtccagacttaattattgacggtccattacaatatgacgcagcggtaatggaagatgtggctcgttctaaagcgccaaattctccggttgcaggtaaagcgactgtatttgtcttcccagacttaaatacaggtaatacaacttataaagcggtacaacgttcagcagatttagtttctatcggtccaatgcttcaaggtatgcgtaaaccggttaatgacttatctcgtggtgcgttggttgatgatatcgtttacaccatcgcattaaccgcaatccaagcaactcaagcttaa

SEQ ID NO: 1528 - DNA, 2139 bp, Haemophilus ducreyi 35000HP
atgtctaggacgattattcttatcccaatcacaactgatgttggtcttacaagcgttagcttaggattagttcatgcattagaacaaaaaggaattaaagttggctttttaaaacctattgctcaaccgattagcggtgaagataaattagaccgctctacttcaattattcaagctgctcaaacaacagaagtgggcgagccacttctgttaagtgaagcggaattattaattggccagaatcaagcagatgttttattagaaaagattgttgagcgttaccaacaattgtctaaaaataatgaagtgattattattgaagggttaatcccaacgcgtaaaaattcatacgcaaacagcattaattatgatgttgcacaagcattagatgcagaaattattttagtggcagcgccaggttcagataaacctgtacaattaaaagaacgtatagaagcggttgcatcagagtttggtggtcgtgataatcctaacttattaggcgtaatcattaataaatttaatgcgcctgtagatgagtcaggtcgtactcgcccagatctaactgaaatttttgattcattccaacatagtgcacaaaacattgcagaagtagaagcactatttgctaaaagcccaattaatttattggcttgtataaaatggaaatccgatttaattgcaactcgtgcaattgatgtcgccaaacatttacatgccgccattattaatgaaggtgatttacacactcgccgtatccgtggtgtttcattttgtgcgtgtagtattccgcatatggttgactactttaaagcgggtaatttattggttacttctgccgatcgcccagaagtattagttgctgcttctttagctgtaatgaatggtattgaaattggtgccatattattaaccggtggatataaaattgatcataatgttgccaaactttgtcaacaagcgtttgaaacaggcttacctgtattccgtgttgaaggaaatacttggcaaactgcattaaatctacaaagtgttagcttagaagtgccagtagatgataaaggacgtattgatgcaattaaagaatatgttgcaagccaatttgatgctcactttgtggatgaagtatctaaagttgcaacgcgtgtacgtcgcctctcccctgctgctttccgttatcaattaacagaatatgcacgtgaagcgaaaaaacgtattgtactgcctgaaggtgatgagcctcgtactattaaagctgctgctttatgtgcgaaacgtggcattgcagaatgtgtacttttagctaatcctgttgatgttcaacgtattgcagaggcacaaggggtggtattgggtaaagggattaccattattaatccggaagatgtgagtgaaaactacgtttctcgtttagttgaattacgtaaaaataaaggtatgacggaagtagtcgcgcgtgagcaattaacggataccgtagtgctgggtacaatgatgttagaagcgggagaagttgatggcttagtgtccggtgcagtacataccaccgcaaatacgatccgtccaccaatgcaaatcattaaaactgcaccaggtagctctattgtttcttctatcttctttatgctattaccagatcaagtgctagtatatggagactgtgccgtaaatccggatccaacagcggaacaattagctgaaattgcgatccaatcggcagaatcagcaaaagcatttggcattgatccacgtgtcgcaatgatttcttattcgacaggtagttcaggctctggtgctgatgttgagaaagtaaaagaagcaactcgtattgctcaagaaaagcgcccagatttaattattgatggtccattacaatatgatgcggcggtgatggaagatgtagcacgttctaaagcgcctaattcaccagtagcaggtaaagcgactgtctttgtattccctgatttgaatacaggtaatacaacgtataaagcggttcaacgttctgctgatttagtctctattggtccaatgctacaaggtatgcgtaaaccagttaatgatctttcacgtggagcattagttgatgatattgtgtacactattgcattgacggcaattcaagctactcaatcttag

SEQ ID NO: 1529 - DNA, 2136 bp, Mannheimia haemolytica PHL213
atgtctagaacgatcattcttatccctatttcaactggtgttggtttaaccagtgttagcttaggtttagtacatgctttggagcaaaaaggttctaaagtaggatttttaaaaccgatttctcaacctatcagcggtgaagatacgttagaccgctcaacaacgattatcagagcagaacaaacaacagaggttggtgagccgtttatgttaagcgaagctgaaacattaatcggtcaaaaccaaacggatgtattgttagaaaaagtggtggaacgccaccaaaaattatcaaaaaataatgaaattgtcattgttgaaggtttaattccaacgcgtaaaaactcatacgctaacagcattaactatgaaatggctcaagcccttgatgctgaaattgtattagttgcagcaccggcctcagatacaccagctcaattaaaagagcgagttgaagctgccgcttcacaatttggtggacgtaacaacccaaatttactgggcgttattatcaataaattcaatgcaccagtagatgattcaggtagaacccgtccagatttgactgaaatttttgattcatttcaacactcaaataataatgtttcagaagtcgagcatctttttgctaaaagtccaattaagctgttaggctgtattagctggaaagcagaacttattgctacacgagcaattgatgttgcaaaacatttaggcgcttcaattattaatgaaggcgaaataaaggctcgtcggattcgcggtgtgacattctgtgcacgtaacttaccaaatatggtcgatcattttaaagccggtagtttattagttacctctgcggatcgtcctgaagtgttagttgctgcatcgttggcggtaatgaatggcatcgaaattggtgctattttactaaccggtggttataaaattgatagctcaattgcaaaactttgccaacaagcatttgaaaccggtgtgcctgtattccgtattgaaggtaacacttggcaaaccgcattaagcctacaaagcttcagcttagaagtgcctgtagatgataaagagcgtattgctgcaattaaagaatatatggcaagcaaatttaatgtaggtttcattgatgaggtttctaaagccgctactcgtgcaagacgtttatcacctgcagcattccgttaccaattaaccgaatatgcccgtcaagcgaaaaaacgcattgttttacctgaaggagatgagcctcgtactgtgaaagcggctgcattatgtgctgagcgtggcattgcagaatgtgtgttattagctaacccaacagacgtacaacgtgttgctgaagcacaaggcgtggtattaggtaaaggcgtaacgattattgaccctgcgagcattcgtgaaaattatgttgatcgcttagttgaattgcgtaaagcaaaaggaatgactgaagttgttgctcgtgagcaacttttagatacagttgtattgggtacaatgatgcttgaagctaatgaagtggacggtttagtctcaggcgcagttcacacaaccgctaacactattcgcccaccaatgcagatcattaaaactgcaccgggaagctctattgtatcttctatcttctttatgctactacctgatcaagtattggtatatggtgactgtgcggtaaaccctgacccaactgcagaacagctagcggaaattgcgattcaatcagcagaatctgccaaagcctttggtattgaccctcgtgttgcaatgatctcctactctaccggtacatcaggttcaggtgcggatgtagaaaaagtgaaagaagcaactcgtattgcccaagaaaaacgtccagatttaatcattgatggcccattacaatatgatgcggcgattatggaagatgttgcccgctcaaaagcaccaaattcacctgtagcaggtaaagcaactgtatttgtcttcccggatttaaatactggtaataccacctataaagcggtacaacgttcggcagatttagtctctatcggcccaatgttacaaggtatgcgtaaacctgtaaatgacttgtcccgtggggctttagttgacgacatcgtttatactattgcgttaactgcgattcaagcaacgcaataa

SEQ ID NO: 1530 - DNA, 2136 bp, Haemophilus parasuis SH0165
atgtccagaacaattattttaattccaatcagtaccggcgttggtttaaccagtgtaagtcttggtttagtccattctcttgaacaaaaaggggcaaaagttggtttcttaaaacctatcgcacaacctattagtggtgaagatacccttgaccgttcaaccactattatccgcctttcacaaagtaccgaaacaggcacaccatttatgctaagtgaagcggaaacattgattgcaaaaaaccaaaccgatgtattacttgaaaaagtggttgagcgtcatcaaaaactcaccaaaaacagtgatattgttattgtggaaggcttaattccaacgcgtaaaaactcttacgcaaatagcattaactatgaaattgcacaagcattagacgctgaaatcgtgttagttgcagcaccagcggcagacaaaccagctcagcttaaagagcgtattgatgcggcagcttctttatttggtggtcgccacaaccctaacctactcggtgtggttattaacaaatttaatgcccctgttgatgagtcaggtcgtacacgcccagatttaaccgaaatcttcgactcgttccaacacagcagcaataacattcttgaaatggaaaacctgttcaaagctggtccaatcaaattactagcttgtatttcgtggaaatcagatttaattgcaacccgtgcaatcgatcttgtaaaacacctaggtgcggcaattattaatgaaggtgaagtacataaacgccgtattcgtagtgtaacattctgtgcaagaagcctaccacatatggttgatcactttaaagcgggcagtttattagttgcttctgcagatcgtcctgatgttatcgttgcagcatctttagcagcaatgaatggcgtggaaatcggtgcgttactcttaacgggtggctacaaaattgatactcaaattgccaaactttgccaacaagcctttgaaactggcttaccaattttccgtattgaaggaaacacttggcaaactgcattaagcctacaaagcctcagccttgaagtaccagttgatgataaagagcgtattgatgcgattaaacaatatgtctcagaacaatttgatgcagactttattgaaggtatttctaaaggtgcagttcgcgctcgtcgcctctcccctgctgcattccgttatcaattaaccgaacttgcgcgtgaagcgaaaaaacgcattgtgttaccagaaggtgatgagcctcgtaccgttaaagcggctgcactctgtgcggaacgtggcattgcagaatgtgtacttttagcgccacctgctgatgttcaacgtgttgctgaagctcaaggggttactttaggcaaaggcattaccattattgacccagctgaagtgcgtgaaaactatgtggctcgtttagtcgaattgcgtaaaaacaaaggtatgactgaggttgttgctcgtgaacaactgttagatactgttgtactcggtacaatgatgttagaagcaaacgaagtagatggcttagtttcaggtgcagttcacacgactgcaaatacaatccgtccaccaatgcaaattatcaaaacagcaccaggtaactctattatttcatctgtgttctttatgttattaccagatcaagtacttgtttacggtgactgtgcggtaaacccagatccaacacctgaacaattagccgaaatagctatccaatcggctgaatcggcaaaatcattcggtatcgatcctcgtgttgcaatgatttcttactcaacaggaacttctggtgctggtgcagacgtagaaaaagtagctgaagcaactcgtattgcgaaagaaaaacgcccagaccttattattgacggtccattacaatacgatgcggcaattatggaagatgtggctcgctctaaagcgcctaactcccctgttgcaggtaaagcgaccgtattcgtcttcccagacttgaacacaggtaacacaacttataaagcggttcaacgctctgcggatctcgtgtctatcggtccaatgctacaaggtatgcgtaaacctgtgaatgacttatctcgtggtgctttggttgatgatattgtttataccattgcattaacggcaattcaggcgactcagtaa

SEQ ID NO: 1531 - DNA, 2145 bp, Pantoea sp. At-9b
gtgtctcgtacaattatgctcattccaaccggcaccagcgtcggcctgaccagcgtcagccttggcgtaatccgtgcaatggaacgcaaaggcgtgcgcctgagcgtattcaagccaatcgcccagccgcgcgctggcggcgatacgccggaccagaccaccactatcatccgtaagaactccgcgatcccagccgccgaaccgctgctgatgtcacgcgttgagtcgctgctgggttccaaccagcaggacgtgctgatggaagagatcatcgcccgctaccacgaaaacaccaaagacgccgaagtggtgctggttgaaggtctggtgccaacgcgcaagcatcaatttgcttctgcgctcaactatgaaatcgctaaaaccctgaatgcggaaatcgtattcgtgaccgcactgggcaacgattcaccggcccaattgaaagagcgtatcgaactgacgcaaagcagctttggcggcagcaagaacaaaaacatcaccggcgtgatcatcaataaattgaatgccccggtggatgaacaaggccgtacccgtccggacctgtcagagatctttgacgactcttccaaagccagcatcgccaacatcgatccgaagcagctgtttgccgacagcccgctgccggtactgggttgtgtgccgtggagttttgacctgattgccacccgtgcgattgatatgtctcgccacctgaacgctgacatcatcaatgaaggtgatatccatacccgtcgggtgaaatccgtcaccttctgcgcccgtagcattccgcatatgctggaacatttccgtccgggttccctgctggtgacctcagcagaccgccctgacgtactggtcgcagcttgtctggccgcgatgaatggcgtggagattggtgccattctgctgaccggtggctatcagatcgatgaacggattggtcgtctgtgcgaacgcgccttccagactggcctgccggtatttatggtgaaaaccaacacctggcaaacctcgctgagcctgcaaagcttcaaccttgaagttccggctgacgatacacagcgcatcgagaaagtgcaggaatacgttgccagctacattaacaacgactggatcgaatcactcacggcaacctcagagcgcagccgtcgcctgtcgccgccagccttccgttaccaactgaccgagctggcacgcaaagcgggcaaacgcatcgtactgccggaaggcgacgagccacgtaccgtgaaagcggctgccatctgcgctgaacgtggtatcgccacctgtgtgctgttgggtaacccggacgagatccaacgcgttgccgccgctcagggtgttgaactgggcaaaggtatcgagattgttgatccggaagtagtacgtgagaactacgtgccgcgcttggttgaactgcgtaagagcaaaggcatgaccgaagtggtcgcgcaggaacagctggaagacaacgtggtgctcggcaccatgatgctggaaagcggcgaagtcgacggcctggtctccggtgcggtgcacaccacggccaacaccatccgtccaccgttgcagctgatcaaaaccgcgccgaacagctcactggtttcttcggtgttctttatgctgctgccggagcaggtgctggtatatggcgactgcgccatcaacccagacccgaacccggaacagctggctgaaatcgcaattcaatccgccgattctgccaaagccttcggtatcgatccgcgcgtggcgatgatctcctactccaccggtaactctggtgccggtagcgatgttgagaaagtacgtgaagcaacgcgtatcgcacaggaaaaacgtccggatctggtgatcgacggtccgttgcagtatgacgccgccattatggaagacgtggcgaaatccaaagccccgaactcgcaggttgcgggtcgtgcaacggtgttcatcttcccggatctgaacaccggtaacaccacctacaaagcggtacagcgttccgctgacctgatttctatcgggccgatgttgcaggggatgcgcaagccggtaaacgacctgtcacgcggtgcactggtggatgatatcgtctacaccatcgcgctgacggcgattcagtcacagcaggctgaaggctaa

SEQ ID NO: 1532 - DNA, 2130 bp, Erwinia tasmaniensis Et1/99
atgttgatccctaccggcaccagcgtcggcctgaccagcgtcagcctcggcgttattcgtgctatggagcgtaaaggcgttcgtcttagcgtgttcaaacctatcgcccagccacgcgccggaggcgacacgccggatcaaaccaccaccattatccgcaaacactccgatattcccgccgccgtaccgctggctatgagccgcgtggagtcactgctgggttccaaccagcaggacgtgctgatggaagagatcatcgccagctatcacgaaaatacccaagaggctgaagtggtattggtagaaggcctggttcccacgcgcaagcaccagttcgcctccgcgctgaactatgaaattgccaaaacgctgaatgctgaaatcgtcttcgtgacggcgctgggcaatgactcggcggatcagctgaaagagcgcattgaactgacgcaggccagctttggcggcagcaagaataaaagcattaccggcgtcatcatcaataaactcaatgctccggtggatgaacaaggccgtacccgtccagacctgtcggaaattttcgatgattccagcaaagccagcgtggccaatatcgatccgaaacagctgtttgccaacagcccgctgccggtactgggctgcgtgccgtggagctttgagctgatcgccacccgcgctatcgatatgtgccgccacctgaacgccagcgtgatcaacgaaggcgaaattgcgacacgccgcgtgaaatcggttacgttctgcgcacgcagcctgcctaatatgctggaacatttccgccctggctccctgctggtcacctctgccgatcgcccggacgtgctggtcgctgcctgcctggccgcgatgaacggagtcgagattggcgccatcctgctgaccggcggctacgccattgatgcaccgattcagaaactgtgcgaacgtgccttccagaccggcctgccggtattccgcgttgataccaatacctggcagacctcgcttagcctgcaaagttttaacctcgaagtgccgagcgatgatacccagcgtattgaacgcgtgcaggagtatgtggccagccacattgatgccgagtggatcgaatccctgaccgccacctccgagcgcagccgtcgcctgtccccaccggcattccgctaccagctcaccgagctggcgcgcaaagccggcaagcgcatcgtactgccggaaggtgacgaaccgcgtaccgttaaagcggcggctatctgcgccgaacgcggtatcgccacctgtatcctgctgggcaacccggaagagatccagcgcgttgcggcagatcagggcgttgagctgggcaaagggattgaaattgtcgatccggccagcgcacgcgaacactatgtggcgcgtctggtggagctgcgtaagagcaaaggcatgaccgaagtggtggcgcaggagcagctggaagataacgtgatgctcggcaccatgatgctggagcgcggcgaggtggatggactggtctccggggcggtacacaccacggcgaataccattcgcccgccgttgcagctgatcaagaccgcgccaaacagctcgctggtctcgtcggtgttctttatgctgctgcctgagcaggtgctggtgtacggcgactgcgccatcaacccagacccgaacccggagcagctggcagagatcgcgatccagtctgcagattcagcgctggcgttcggtattgaaccgcgcgtggcgatgatctcctactccaccggtaactctggagccggtagcgatgtggaaaaagtgcgtgaagccacgcgcatcgcccaggaaaaacgtcccgatctggtgatcgacgggccgttgcagtacgacgcggcgattatggccgacgtggcaaaatcaaaagcgccaaactccccggttgcgggccgcgctaccgtgtttatcttcccggatctgaacaccggtaacaccacctacaaagcggtgcagcgctctgccgacctgatctccatcgggccaatgctacagggcatgcgcaagccggttaacgacctgtcgcgcggcgcgctggtagacgatatcgtctacaccatcgccctgacggcaattcagtcgaagcaggctgagggctaa

SEQ ID NO: 1533 - DNA, 2145 bp, Sodalis glossinidius str. 'morsitans'
gtgtcccgtacaatcatgttgatccctaccggcaccagcgtcggtctgaccagcgtcagcctcggcgttatccgcgccatggagcgaaagggcgtgagcctgagcgtgttcaaacccatcgcgcagccccgttccggcgaggacaccctcgacgccaccacccgtattatccgcgccaactccaccattccttccgccgaaccgctggccatgagctatgttgaatcgctgctcggctccaaccagcaagacgtgctgatggaagagatcatcgcccgctatcatgccaacacccaagaggcggaagtggtgctggtggaaggcctggtccccacccgtaaacatcagttcgccacagcgctgaactacgaaatcgcccggacgctcaacgccgagatcgtctttgtgctgtcgttgggcaacgattcgccggaccagctgaaagaacgcatcgagctggtacgttcgagcttcggtgggagcaaaaataaaaacatcaccggcgtcatcgtcaacaaattgaatgcgccagtggatgaacaaggtcgcacccgcccggatttgtcggagattttcgacgattccagcaaggccagcgtcgccaatgtcgatccgagcctgctgtttgaaaacagcccgctgccggtgctgggctgcattccctggaatttcgaccttatcgctacgcgcgccatcgacatggcgcgccacctgggcgcgacgattatccacgaaggggaaattcagacccgtcgcgtgaaatccgtcacgttctgcgcgcgcagcctgccgaatatgctggagcatttccgccccgggtcgctgctggtcacctccgctgaccgtcccgacgtactggtcgccgcctgcctcgccgctatgaacggcgtggaaatcggtgcggtactgctgaccggcggctatgacatcgatccgcgcattcagaaactgtgtgaacgcgccttccagaccggcctgccgatgtttaccgtgcagaccaacacctggcagacctcgctcagcctgcaaagcttcagcctggaagtgccggccgatgaccacagccgggtggaaaaactgcaaaactatgtcgcgggccatatcgataatgcctggatcgaatcgctgtccgccagctccgaacgtccgcgccgcctatcgccgccggcgttccgttatcagttgaccgaactggcgcgccaggcgggtaaacgcatcgtcctgccggaaggcgacgagccgcgcaccgtgaaggcggcatccatttgcgccgagcgctgcattgcccattgcgtcttgctgggcaaccccgatgagattcagcgcgtcgccgcggtacaaggcgtgacactcggcgacggcatcgaaatcatcgatccggaagtggcgcgcgagaagtatgtcgcccgtctagtcgaactgcgcaaaagcaaaggcatgaccgaagtggtggcccacgaacagctggaagacaacgtggtgctgggcacgctgatgctggagcaaggcgaagtagacgggctggtgtcaggtgcggtacataccaccgccaacaccatccgcccgccgctgcaacttatcaagaccgcgccgggcagttcactggtgtcgtcggtgttctttatgctgctgcctgaacaggtattggtgtacggcgactgcgccatcaacccggatccgacctcggagcaattggcggagatcgctatccagtcggctgattccgctgccgccttcggtattgaaccacgcgtggcgatgatttcctactccacgggcaactccggcgccggcagcgacgtcgagaaggtgcgcgaagccacccgtctggcgcaggaaaaacgccaggacctggtcattgacggcccgctacagtatgacgccgccattatggccgacgtcgcgctgtcgaaagcgcccaactcgccggtggccggtcaggcgacagtgttcatcttcccggatttgaacaccggtaatacgacctataaagcggtgcagcgttcagcggatctgatctccatcggcccgatgctgcaggggatgcgcaagccggtcaacgacctctcgcgcggtgcgctggtagatgatatcgtctataccgtcgccctgaccgctattcagtcgaagcaggcggaaggctga

SEQ ID NO: 1534 - DNA, 2142 bp, Dickeya dadantii Ech586
gtgtcccgtacaatcatgttgattcctactggcaccagcgtgggcctgaccagcgtcagcctgggtgtcattcgttccatggaacaaaaaggcgtgcgtctgagcgtattcaagcctatcgcccagccacgttccggtgatagcacactggatcagaccaccactatcgttcgcgccacatccgccattccagccgctgaaccgctggcaatgaactacgtggaatccatgctgagcagcaaccagcaggacgttctgctggaagagatcatcgctcgctaccacgaaaacaccaaagacgcagaagtcgtgttggttgaaggtctggtaccgacccgtaaacaccagttcgccaacgcgctgaactatgaaatcgccaaaacgctgaacgcggaaatcgtcttcgtactggcgctgggtaatgactccccggcacagttgaaagagcgtatcgatatcgcccgctccagcttcggcggcagcaagaacaaaaacatcaccggcgttatcatcaacaaactgaatgcgccggtcgatgaacagggccgtacccgtcctgatctgtctgagatctttgacgattcgaccaaagccagcgttgccaacatcgatccgaagctgctgtttgccaacagcccgctgccgattctgggttgtgtaccctggagcttcgatctgatcgccacccgcgccatcgacatggccaaccacctgaacgctcgtgttatcaacaccggcgacattcagacccgtcgcgtgaaatcggtaacgttctgcgcccgcagcattccgcacatgctggagcatttccgcccggggtcactgttggtgacctcagctgaccgtccggatgtactggttgctgcctgtctggctgccatgaacggtgttgaaatcggtgccctgctgctgaccggcggttacgaaatcgacccggctatcagcaagctgtgcgaacgtgccttccagaccggcctgccggtgttcatggtcaagaccaatacctggcagacctcactgaacctgcaaagcttcaatctggaactgccgccggacgaccatgagcgtgtggaaaaagtgcaggaatacgtggctcgtcacatcgatgcccagtggattgactccctgaccgccacctctgagcgttcacgtcgcctgtctccgccagcgttccgttatcagttgaccgaactggcacgtcaggctggcaaacgcatcgtactgccggaaggcgacgaaccgcgtaccgttaaagccgcttccatctgtgccgaacgcggtatcgcacagtgcgtgctgttgggcaacccggatgaaatccagcgtgtcgccgctgcacagggtgtggaactgggcaaaggtatcgagattatcgacccggttgaagcccgcgaacgctatgtcccgcgtctggttgaactgcgtaagagcaaaggcatgaccgaagtggtcgcccgcgaacagctcgaagacaacgtggtactgggtaccctgatgctggaacaaggcgaagttgacggtctggtctctggtgccgttcacaccaccgctaacaccattcgtccgccgttgcagttgatcaaaaccgcaccgggcagctcactggtgtcttccgtgttcttcatgctgctgccagaacaggtactggtgtatggcgactgcgccatcaacccggacccgacggctgaacagctggctgaaatcgctatccagtccgccgactcggctgccgctttcggcatcgacccgcgtgtggcgatgatctcctactccaccggtaactccggtgcgggcagcgatgtcgataaagttcgtgaagcaacccgtctggcgcaggaaaaacgcccggatctggtcatcgatggcccgctgcagtacgacgcggctatcatggctgacgttgcacagtccaaagcaccgaactcaccggttgctggtaaagccaccgtgttcgtgttcccggacctcaacaccggtaacaccacttacaaagcggtacagcgttctgccgacctgatttccatcgggccgatgctgcaaggcatgcgtaaaccggttaacgacctgtcccgtggtgcactggtagacgacatcgtctataccgtagccctgaccgctattcaggctactcagattgcctga

SEQ ID NO: 1535 - DNA, 2139 bp, Pectobacterium wasabiae WPP163
gtgtcccgtataatcatgttgatcccaactggcaccagcgtcggtctgacaagcgtcagcctgggtgtcattcgttccatggaacagaaaggcgttcgcctgagcgtgttcaaacctatcgcccagccgcgcagtggcgacaatacgcccgatcagacgaccactattatccgcgctaattccgctatcaacgccgccgaaccactggcgatgagccgcgttgaagccctgctgagctccaaccagcaagacgtgttgatggaagaaatcatcgcgcgctaccacgaaacgaccaaagatgctgaagtcgttctggttgaaggtctggttcctacccgtaagcaccagtttgctaacgcgttgaactatgaaatcgccaaaacgctgaacgcagagatcgtcttcgtactggcgctgggtaacgattctccggcacaactgaaagaccgcatcgaattggcacgctctagcttcggcggcagtaaaaataaaaacatcactggcgtgatcatcaacaaactgaatgcgccggtagatgatcagggccgtactcgccctgacctgtctgaaatctttgatgactccacgaaagccagcgttgccaacatcgatcctaagcaactgttcgctaacagcccactgccggttctgggctgcatcccgtggagcttcgacctgattgccacgcgcgccatcgatatggcgaagcacctgagtgcccgtatcgtcaatgaaggtgacattcagacgcgtcgcgttaaatctgtgactttctgcgcacgcagcattcctcatatgctggagcatttccgtccaggttcactgctggtgacctctgctgaccgtcctgatgttctggtcgcggcttgcctggctgccatgaacggcgtggaaatcggtgccttgctgctgactggcggctacgaaatggatccaagcattgccaagctgtgcgagcgtgccttccagactggcctgccagtatttatggtcgataccaacacctggcagacctcactcagcctgcaaagcttcaaccttgaagtaccggctgatgaccgtcagcgtgtcgagaaagtgcaggaatatgttgcacgccacatcgatacccagtggatcgactctctgagcgctgaatctgagcgttcacgccgtctgtctccgccagcattccgttatcagcttactgaactggcacgcaaagcgggcaaacgtatcgttctgccagaaggtgatgagccacgtaccgttaaagccgctgcaatctgtgcagagcgtggcattgcacactgtgtgctgatcggtaacccggaagagattcaacgagttgccgccgctcagggcgtagaactgggcaaaggcatcgaaatcgtcgatccgattgtcgtgcgtgagcgctatgttgcgcgtctggttgagctacgtaagaacaagggcatgaccgaagtggttgcgcgcgaacagctcgaagataacgtcgttctgggtacgttgatgctggaacagggcgaagttgatggtctggtttctggtgccgtccataccaccgctaacaccatccgtcctccgttacagttgatcaaaactgcaccgggcagttcactggtgtcttccgtgttcttcatgctgctgcctgagcaggttctggtttacggcgactgcgccatcaaccctgatccgaccgcagagcaattggctgaaatcgctatccagtctgctgactcagcgactgcattcggtatcgatccacgcgttgcgatgatctcctactctaccggtaactccggcgcgggtagcgatgttgagaaagtgcgtgaagcgacccgtctggcgcaagaaaaacgccctgatctggtcatcgatggtccgctgcaatatgacgccgctatcatggcagacgttgcacagtctaaagcaccaaactcacctgttgcgggtaaagctaccgtgttcatcttccctgacctgaacaccggtaacaccacgtacaaagcggtacagcgttctgccgacctgatctccatcgggccaatgctgcaaggcatgcgtaaaccggttaacgacctgtctcgtggcgcgctggtagacgatatcgtttacaccgtcgctctgaccgcaattcaggctacacagctctaa

SEQ ID NO: 1536 - DNA, 2142 bp, Dickeya dadantii Ech703
gtgtcccgtacaatcatgttgattcccactggcaccagtgtgggactgaccagcgtcagcctgggtgtcattcgttccatggaacagaaaggcgtacgcctgagcgtattcaaaccggtcgcccaaccgcgcgccggcgaaaacgcgctggatcagaccactaccatcatccgtgcaaactcggcaatcaatgtcgtagagccgctgcaggtgagctatgtggaatccatgctgagcagcaaccagcaggacgttctgctggaagaaatcatcgcccgttatcacgaaaatactaaagatgccgatgtcgtcctggtagaaggtctggttccgacccgcaaacaccagttcgccaatgcgctgaactatgaaatcgccaaaacgctgaatgcggaaatcgtattcgttatggcgctaggcaatgactctccggatcagttaaaagaacgtatcgaattggcccgttccagtttcggcggcgccagcaataaaaatattaccggcgttatcatcaacaaactgaatgccccggtggatgaacagggtcgcactcgtcccgacctgtcggaaatcttcgacgattcctccaaggccagcgtgaaaaacgtcgatccgaaacacctcttcgccaatacgccgctgccggtactgggctgtattccctggagcttcgatctgatcgccacgcgcgcgatcgatatggccaaacatcttaatgccaagatcgtcaataccggtgatatcgaaacccgccgggtgaaatccgtcactttctgtgcccgcagcattcctcacatgctggagcatttccgtccgggttcgctgctggtgacttccgctgaccgtcccgacgtgctggtcgccgcctgtctggccgccatgaacggcgtcgagatcggcgcgctgctgctgaccggcggctataccatggaagccagcatcgccaaactgtgcgaacgcgccttccaaaccggtttgccggtattcatggtggaaaccaacacctggcagacctccctgaacctgcagagtttcaatctggaactgcctgccgatgaccgcgagcgcgtggaaaaagttcaggaatacgttgcacgccatatcgattcccagtggatcgactcgctgagcgccgcgtccgaaggctctcgccgtctgtctccgccagcgttccgttatcagctgaccgagctggcccgtaaggccggtaaacgtatcgtactgccggaaggcgacgagccgcgtaccgtcaaggccgctgctatctgtgccgaacgcggtatcgcgcagtgcgtgctgctgggtaatccggaagaaatccggcgtgtggcggcggttcagggcgtagagctgggtaaaggcattgaaatcgtcgacccggccgtggttcgcgaacgttacgtaccgcgtctggtcgaactgcgcaaaagcaaaggcatgaccgaagtggttgcgcgcgaacagctggaagacaacgtggtactcggcaccttgatgctggaacagaacgaagttgacggtctggtttccggtgcggttcacaccactgccaataccatccgcccgccgttgcagttgatcaaaaccgcaccgggcagctcgctggtctcctccgtgttcttcatgctgctgccggaacaggttctggtctatggcgactgcgccatcaacccggatccgaccgccgagcagctggctgaaatcgctatccagtctgctgattccgccacggcattcggcgttgagccgcgcgtcgccatgatctcctactctaccggtaactccggtaccggtagcgacgtggacaaagtgcgcgaagccacccgcatcgccaaggaaaaacgtccggatctggttatcgatggtccgttgcagtacgacgccgccatcatggccgatgttgccaagtctaaggcgccgaactcgccggttgccggtcaggctaccgtgttcgtgttcccggatctgaacaccggcaacaccacatacaaagcggtgcaacgttccgccaacctgatctccatcgggccgatgctgcaaggcatgcgtaaaccggtcaacgacctgtcccgcggcgcactggtggacgatatcgtttacaccgtggcgctgaccgccattcagtcgacccagatcgcctga

SEQ ID NO: 1537 - DNA, 2154 bp, Yersinia pestis KIM 10
gtgtcccgtacaataatgttgatcccaacaggcaccagcgttggtttaaccagcgtcagcttaggtgtcatccgttccatggagcaaaaaggggtaagcttgagcgtattcaagcctatcgcccagccacgtgcgggtaatgatgctcctgaccaaaccacgaccatcatccgggcgaactccagcatcactgctgctgagccgctgaacatgaactacgtggaaaccttgctgagttctaaccagcaagatgtcttgatggaagaaattgttgcccgttatcacgaaaataccaaagacgcagaagtggttctggttgaaggtctggtgcctacacgcaaacatcagtttgccaatgcactgaactatgaaatcgctaaaacgctgaacgctgaaatcgtctttgttattgcccttggtaatgactcgccagatcagttgaaagagcgtatcgaactggcccgctccagttttggtggcagcaagaacaaaaacatcactggcgttatcatcaataaactgaatgccccggttgatgaacaaggccgtacccgccctgacctgtctgaaatctttgatgactccaccaaggccagtgttgcgaacatcgatccaagccagctattcgctaacagcccgatccctgttctgggttgtgtaccgtggagcttcgagctgatcgccacccgtgccattgatatggccaagcacctgaatgcccgcattattaacgaaggcgatattaaaacgcgtcgagttaaatccgtgacattctgtgcgcgcagcatcccgcatatgctagagcacttccgtccgggttctctgctagtgacctcagcagaccgccctgatgtgttggtgtctgcctgtttggcggcgatgaacggtgtggaaatcggtgccatcctgctgacgggaggttatgccattgatgatcgtatcaataatttgtgtgaacgtgccttccaaactggcttgccagtatttatggttgataccaacacctggcagacctctctgagcctgcaaagctttaatctggaagtcccagcagatgaccatgagcgtgttgagaagttgcaaaactacgttgccagccatatcagcagcgagtggatcgactccctgaccgccgcctctgagcgcccacgtcgcttgtctccaccggccttccgttatgagctgactgagttggcccgtaaagctggcaaacgtatcgtactgccagaaggcgatgagccgcgcaccattaaagccgcgtctatctgtgctgaacgtggtatcgccacttgtgtcctgttgggtaacccggaagagatccaacgcgttgccacatctcaaggtgttgagttgggtaaaggcgttgaaattatcgaccctgttgcggtacgtgagcaatatgttccacgcttggttgagctgcgtaagagcaaaggcatgaccgaagtggttgcccgtgaacagttggaagacaacgtggttcttggcaccctgatgctggagaaaggggaagttgacggtctggtttctggtgcagtacataccaccgcgaacaccatccgcccaccactacagttaatcaaaactgcaccgggcagttcgctggtctcctctgtgttcttcatgctgctgcctgaccaggttctggtgtacggcgactgcgcgatcaacccagatccaacggcggagcaactgtctgagattgctatccaatcggctgattctgcggcagcctttggtatcgaacctcgtgtggcgatgatctcgtactccaccggtaactccggtgccggtagcgatgtcgaaaaagtgcgtgaagcgactcgtctcgcccaagaaaaacgcccagatctgatcatcgatggcccgttacagtatgatgcggcaatcatggcggatgtggctaaatctaaagcgcctaactcaccggtagcaggtagagcgaccgtgttcatcttcccagacctgaacaccggtaacaccacctataaagccgtgcaacgttctgccgacctgatctctatcgggccgatgttgcaagggatgcgcaagccggtgaatgatttgtcccgtggtgcgctggtagacgatattgtctataccgtggcgctgacggcgatccaatcagctcaggctgattcagccgcgtcttaa

SEQ ID NO: 1538 - DNA, 2190 bp, Serratia proteamaculans 568
atgttaaatcgtgaagaggactattctgtgtcacgtactattatgttgatccccactggcaccagcgtcggcctgaccagcgtcagcctgggtgtcattcgctccatggagcaaaaaggcgttagcctgagcgtattcaaacctatcgcacagccacgtactggcggcgattcgctcgaccagaccaccaccatcatccgcagcagcaactccaccatcacggcggcagaaccactgcgcatgagctacgttgagggcctattgagctccaaccagcaagacgtgctgatggaagagatcgtggctcgctaccacgagaacaccaaagacgcagaagtggtgctgatcgaaggcctggtgccgacccgtaagcaccagttcgccaacgcgctgaactatgaaatcgccaaaacgctgaatgcagaaatcgtcttcgtgctggcgctgggcaacgattccccggcacagttgaaagagcgtatcgaactggcgcgcagcagcttcggcggcagcaaaaacaaaaacatcaccggcgtgatcatcaacaagctgaacgccccggttgacgagcagggccgcacccgtcctgacctgtccgaaatcttcgacgattccaccaaggccagcgtgaccaacgttgacccggcgcaactgttcgccaacagcccgttgccggtgctgggctgcgtgccgtggagcttcgatctgatcgccacccgcgctatcgacatggcccgtcacctgaaggcctccgtggtcaatgaaggcgacatcatgacccgccgcgtgaagtccgtgactttctgtgcgcgcagcatcccgcacatgctggaacacttccgtccgggttcactgctggtaacttcggcagaccgtcctgacgtgctggtttctgcctgtctggcagcgatgaatggcgtagagatcggtgccatcctgctgaccggtggctacgccatcgacgaacctatcagaaaactgtgtgaacgtgccttccagaccggcctgccggtatttatggttgaaaccaacacctggcagacctcgctcagcctgcaaagctttaacctcgaagtgccggcggatgaccaccagcgcatcgagaaagtgcagaactacgtggccagccacatcaacgccgagtggatcgagtctctgaccgccacctccgagcgttcacgtcgcctgtcgccaccagcgttccgttacgagctgaccgaactggcacgtaaagccggcaaacgcatcgtactgcctgaaggcgacgaaccacgtaccgtgaaagcggcggctatctgtgccgaacgtggtatcgctgaatgcgtgctgttgggtaatccggaagagatccagcgcgttgctgccgctcagggcgttgaactgggcaaaggcatcgagattgttgatccggtcgccgtccgcgaacagtatgtgccgcgtctggttgagctgcgcaagagcaagggcatgaccgaagtggttgcgcgtgagcaactggaagacaacgtggttctcggcaccctgatgctggagaaaggcgaagttgacgggctggtttccggcgcggttcacaccaccgccaacaccattcgtccaccgctgcagttgatcaaaaccgcaccgggcagctcactggtgtcctccgtgttcttcatgctgctgcctgaccaggttctggtgtacggcgactgtgcgatcaacccggatccaaccgccgagcagctgtccgagatcgccattcagtcagccgactctgctgccgccttcggtatcgaaccacgcgtagcgatgatctcctactccaccggcaactcaggtgcgggcagcgacgttgagaaagtgcgcgaagcaacccgtctggcgcaggaaaaacgtcctgatctgatcatcgatggtccgttgcagtatgacgccgcgatcatggctgacgtagccaaatccaaggcgcctaactcgccggttgcaggccaggctaccgtgttcatcttcccggatctgaacaccggtaacaccacctacaaagcggtacagcgttctgctgacctggtgtccatcgggccaatgctgcaaggcatgcgcaagccggtgaacgacctgtcgcgtggcgcactggtagacgacatcgtttacaccgtggcgctgaccgccatccagtcttcccaggctgatgctgcagcagtcaaagcctga

SEQ ID NO: 1539 - DNA, 2139 bp, Edwardsiella ictaluri 93-146
gtgtcccgtacaatcatgttgatccccaccagcaccagcgttggcctgaccagcgttagcctgggtgtcattcgttccatggaacaaaaaggcgtacgtctgagcgtattcaaaccgatcgcccagccgcataccgacgtcgatgcgccggatcagaccaccaccatcatccgcgccaactccaccatcccggcggccgagccgctgcgcatgtcccacgtggaagcgctgctgagctccaaccagcaggacgtactgatggaggagatcgtcgcccgctatcatgaaaacaccaaagatgccgaggtggtgctggttgaaggcctggtgccgacccgcaaacaccagttcgccaacgccctgaactacgaaatcgccaagaccctgaacgccgaaatcgtcttcgtgatggcgatgggcagcgacactgtcgatcaggtgaaagagcgcatcgaactggcccgttccagcttcggcggcagcaaaaaccagaatatcgccggcgtgattatcaacaagctgaacgcaccggttgacgaacagggacgcacccgccccgatctgtctgaaatcttcgacgactccggtaaggcacgcgtagcgaccctggatgccgcacaggttattgccaacagcccgctgccggtgctgggctgcattccgtggagcttcgagttgattgcgacccgcgccatcgacatggctaaccacctgaaggcgcgcgtgatcaacgccggcgacatccagacccgccgtatcaagtccgtcaccttctgcgcacgcagcatcccacacatgctcgaacacttccgtccgggctccctgctggtgacctctgccgatcgtccggatgtcctgatcgccgcctgtctggctgcgatgaacggggttgaaatcggcgctctgctgctgaccggtggctatgaagtcgacgcacgcgttaacaaactgtgcgagcgcgccttccagaccggtctgccggtattcatggtcgataccaacacttggcagacctctctgagcctgcagagcttcaatctggaagtgccggccgacgatcatcaacgcatagagaagctgcaggacttcgtggccagccatatcgatgcgcagtggatcgagtccctgagtgcggcctctgagcgctcacgtcgcctctctccaccggcgttccgctacgagctgaccgagctggcccgcaaggccggtaaacgtatcgtcctgccggaaggcgacgagccgcgcaccgtcaaagcggccgccatctgcgccgaacgcggcatcgcacagtgtgtgctgctgggtaacccggacgaaatccagcgcgttgccgcagctcagggcgtgacgctgggcaagagcatcgaaatcgtcgatccggtcgccgtacgtgaaaaatatgttccacgtctggtcgagctgcgcaagaacaaggggatgaccgaggtcgtcgcccgtgagcagctggaagacaacgtagtgctgggtaccctgatgctggagcagaatgaggtcgatggcctggtatccggcgcggtacacaccactgccaataccatccgtccgccgctgcagctgatcaaaacggccccgggcagctctctggtctcctccgtattcttcatgctgctgccggagcaggtgctggtgtacggcgactgcgccatcaacccggatccgactgctgaacagctggccgaaatcgccatccagtccgccgactcggccgcagcctttggcatcgacccgcgcgtggcgatgatctcctactccaccggtaactctggcgcgggaagcgacgtggagaaagtccgcgaagcaacccgtctggcgcaggaaaaacgtccggatctggtgattgacggccctctgcagtacgacgctgccatcatggccgacgtagccaaatccaaagcgccgaactcgccggtagccggtaaagcgaccgtgttcatcttcccggatctgaacaccggtaacaccacctacaaagcagtacagcgctccgctgacctggtctccatcgggccgatgctgcagggtatgcgcaagccggtcaacgacctgtcccgcggcgcactggtagacgatatcgtctacaccgtggcactgaccgccattcagtcttctcagcaataa

SEQ ID NO: 1540 - DNA, 2145 bp, Proteus mirabilis HI4320
gtgtcccgtacaattatgctagtcccaactgatacacgcgtaggtttaaccagcgtcagcttgggtgtaatccgttctatggaacaaaaaggcgttcgccttagtgtattcaaacctatcgcacagcctcgtgttaaaggcgcattagatcaaaccactgcgattatccgctctcactccacaattcaatccgcagaacctttaaatatggattacgttgagtcattactcagctccaataaaaaagatgttctgatggaagaaattgttgctagatatcacgaaaatactgctgatgcagaagttgtactgatagaaggcttagtgccaatgcgtaagcacccttttgcacaatctttaaactatgagattgccaaaacattaggtgctgaaattgttttcgttactgcattaggcaacaacaccgctgagcagttaaaagagcgcattgaatttgctcgtgctgaatttggtggtgtaaaaaatcaaaatatcacaggtgtgattgttaataaattaaatgcccctgtggatgatcaaggtcgtactcgccctgatttatcagaaatttttgatgactcaagcaaagcgattatctctaatgtcgatttaaataccatcgaaaaaaatagcccacttcctttattgggttgcattccatggaacttcgatttaatcgctactcgtgctacagatatggcaaaacacttaaatgcgactatcatcaataagggtgatattgaaactcgtcgtattaagtctgtgactttctgtgctcgtagtattccacatatgttagagcatttccgcccaggttcattgcttgtcacttctgccgatcgcccagatgttttagtttcagcatgtcttgctgcaatgaatggcgttgaaatcggtgctatcttactcacaggtggttaccaaatcgatgcaccaattaaacaattgtgtgagcgtgcatttgaaactggtctacctatctttatggttaattcaaacacttggcagacttcattaaatctgcaaagctttagcttagaagtgccagcagatgaccatgagcgtatcgaaaaaattcagaactatgttgctcaacatatcaataaccaatggattgattcactgacagcaaactctgaacgtcctaatcgtttatcaccaccagcattccgttatcaattaacggaattagctcgtaaggcgaaaaaacgcatcgtattacctgaaggtgatgaacctcgtaccgttaaagccgcgtctatttgtgctgaacgtggtatcgcaacctgtgtactgttaggtgatcctgaagaaattcgtcgtgttgctgcagcacaaggtgttgaattaggtacaggtattgaactcatcaatcctaaagaagtacgtgaaatttatgtacctcgcttagttgaactgcgtaaaaacaaaggtatgacagaagttgttgctcgtgaacagttagaagataacgttgttctcggtaccttaatgttagaaaaaggcgtcgttgatggtcttgtttctggcgctgttcatacaaccgctaacactattcgcccaccactacagttaattaaaactgcacccggtagctcattagtgtcttctgtgttctttatgctattaccagaacaagtctatgtttatggtgactgcgcaattaacccagatccaaccgcagaacaactggctgaaatcgctattcaatctgcagactcagcaaaagcgtttggtatcgacccacgcgttgcgatgatctcttactctacaggtaactcaggtgctggcagtgacgttgaaaaagtgcgagaagcaactcgtttagcacaagaaaaacgtccagatctgattattgatggtcctttacaatacgatgcggctgtaatggctgacgttgctaaatctaaagcaccaaactcacctgttgcaggtaaagcaactgtgtttatcttccctgatctaaacaccggtaacactacctataaagcagtacaacgttcagcagacttggtttccattggaccaatgttacaaggtatgcgtaaacctgttaacgacctttctcgtggcgcgttagtcgatgatatcgtctacactgttgcattaactgcaattcaagcaagccaacaagaaaatgcctaa

SEQ ID NO: 1541 - DNA, 2142 bp, Photorhabdus luminescens subsp. laumondii TTO1
gtgtcccgtacaattatgttaatccctactagcaccagcgtcggcttgaccagtgttagtttaggtgtcatccgctcaatggaacaaaaaggcgtcagcctgagtgttttcaaacctatcgcccagcctcgttgccgtgccgcccaagatcaaaccaccaccatcatccgcgctaattccagcataaagaccgctgaaccgctggacatggcacatgtggaatctttgctgacaaccaatcagaaagatgtgctgatggaaaagatcgtggccctttaccacgaaaataccaaagacgcagaagtcattctgattgaaggtctggttccaacccgtaaacattcattcgcccaatctctcaactatgaaattgccaagaccctgaacgctgaaatcgtattcgtattggcgctaggtaacgattccccggaacagttgaaagaacgagttgaactggctcgtgctgaatttggcggtaacaaaaaccagaacattaccggcgttattatcaataaactgaatgcgccagttgatgatcaaggccgtacccgtccggatctgtcagaaatctttgacgaatcctcaaaagccatcgtatccaacatcgatccgaacacgctgttcaaaaatagcccattgccaattctgggttgcattccgtggagttttgacctgattgcaacccgcgcaattgatatggcaaaacacctgaacgcccgtattatcaacgaaggtgcaatcaaaacccgccgtgtgaaatctgtgactttctgtgcccgcagcattccacacatgttagagcacttccgtcccggttctctactggtcacttcggctgatcgtccagacgttctggtttcagcttgtctggcggcgatgaatggggttgaaatcggtgcaatcctgctgactggcggttatgccatcgatgagccgattaagcaattgtgcgaacgtgccttcaacactggcctacctgtctttatggttgataccaacacctggcaaacttctctgaacctgcaaagtttcagcctggaagttccggcagatgaccatgaacgcatcgaaaaactgcaaaactacgtcgcacaccacatcaacaaagagtggatcgactccctgacagcgaactctgagcgcccacaccgcctctctccacctgcattccgttatcaattaaccgaactggcacgcaaagcaggcaaacgcgttgttctgccggaaggtgacgaacctcgtaccgtgaaagcggcatctatctgtgctgatcgcggtatcgcgcgatgtgttctgctgggtgatccagaagagatccgtcgggttgccgcggctcagggcgtagaactgggtgcaggtattgaaattgtcgatcccattgctgtacgtgaacgttatgtcccacgtctggttgagctacgcaaaaacaaaggcatgaccgaagtcgttgcgcgtgaacaattggaagacaacgttgttctgggtacgttgatgctggaacagggcgaagtcgatggtttggtttccggtgcggtacacaccacggcaaacaccatccgtccaccattgcaattaatcaaaactgcaccgggtagctcgctggtatcatccgtattctttatgctgctgccagaacaggttctggtttatggtgactgcgcaatcaacccagatccgactgctgaacaactgtctgaaatcgctattcaatcggcggattcagccaaagcatttggtatcgaaccgcgcgttgccatgatctcctactctaccggcaactccggtgcaggtagtgatgttgagaaagtgcgtgaagcaacccgtttagcacaggaaaaacgtccagatctgatcattgatggcccactgcaatatgacgccgcgatcatggcagatgtagcgaaatccaaagcaccaaactcaccggttgccggtcaagctaccgtgttcatcttccctgatctgaataccggtaacactacctataaagcagtacaacgttctgcggatctggtttccatcgggccaatgctgcaaggtatgcgtaaaccggtgaacgacctgtcccgtggcgctttggtagacgatattgtttacaccgttgcactgaccgcaattcaatcagcacaaggggaagcgtaa

SEQ ID NO: 1542 - DNA, 2148 bp, Klebsiella pneumoniae NTUH-K2044
gtgtcccgtactatcatgttaattcctaccggtaccagcgtaggtctgaccagcgtcagcctcggtgtgatccgcgctatggaacgcaaaggcgttcgtctgagcgtctttaaacctatcgcccagccgcgttccggtggcgatgccccagaccagaccaccaccatcgttcgcgccagctcctccaccaccaccgccgctgaaccgctgaagatgagccatgttgagtctctgctctccagcaatcagaaagatgtgctgatggaagagatcattgccaactaccacgcgaatactcaggacgcggaagtggtgctggtggaaggcctggtaccgacccgtaagcatcagttcgcccaggcgctgaactttgaaatcgccaaaacgctgaacgctgaaatcgtcttcgtgatgtctcagggcaccgacacgccagaacagctgaacgagcgtatcgaactgacccgtaacagctttggcggcgccaaaaataccagcatcaccggcgttatcgtcaacaaactgaatgcccctgtcgacgatcagggccgtacccgtcctgacctgtcggaaattttcgacgactcgtcgaaagcaaaaatcgtgaagattgacccggctcagctgcagaaaggcagcacgctgccggtgctgggcgcagtgccatggagcttcgatctgatcgcgacccgcgcgatcgacatggcgcaccatctgaatgcgaccatcatcaacgaaggcgatatcaatacccgccgcgtgaaatccgtgactttctgcgcgcgcagcatcccgcacatgctggaacacttccgccctggttctctgctggttacctccgcagaccgtcctgacgtgctggttgcggcctgcctggcggcaatgaacggcgtggaaatcggcgccattctgctgaccggcggctatgaaatggacgcgcgcatcagcaagctgtgtgaacgcgctttcgcgaccggcctgccggtattcatggtcaacaccaacacctggcagacctccctgagcctgcagagctttaacctcgaagtaccggttgacgatcacgagcgtatcgagaaagttcaggaatacgtggccaactacatcaacgccgactggatcgaatcgctgaccgcgacctccgagcgcagccgccgtctctctccgccagccttccgctaccagctgaccgagctggcgcgcaaagccggcaaacgtgtcgttctgccggaaggcgacgaaccgcgtaccgtgaaagcggcggcgatttgcgccgaacgcgggatcgccacctgcgtcctgctgggtaacccggatgagatcaaccgcgtagccgcggcccagggcgttgagcttggcgccggcattgaaatcgtcgatccggaagtggttcgcgaaagctatgtgggtcgcctggtcgaactgcgtaagaacaaaggcatgaccgaagcggtcgcgcgtgagcagctggaagacaacgtggttctcggcaccctgatgctggaacaggacgaagtcgacggtctggtatccggcgcggttcacaccactgccaacaccattcgtccgccgctgcagctgatcaaaaccgcgccgggcagctcgctggtctcctccgtgttcttcatgctgctgccggaacaggtttacgtttacggcgactgcgcgatcaacccggacccgaccgccgagcagctggcggaaatcgctattcagtccgctgaatccgcgattgccttcggcatcgaaccgcgcgtggcgatgctctcctactccaccggtacctccggcgcgggtagcgatgtcgagaaagtccgcgaagcgacccgtctggcgcaggaaaaacgtcctgacctgatgatcgacggcccgctgcagtatgacgccgcggtgatggctgacgtagcgaagtccaaagcgccgaactcaccggtagctggccgcgcgaccgtgttcatcttcccggatctgaacaccggtaacaccacgtacaaagcggtacagcgctctgccgacctgatctccatcgggccgatgctgcagggtatgcgcaagccggtcaacgacctgtcccgtggcgcgctggtagacgatatcgtctataccatcgcactgaccgcgatccaatcggctcagcagcagaagtaa

SEQ ID NO: 1543 - DNA, 2142 bp, Enterobacter sp. 638
gtgtcccgtattattatgctcatccctaccggaaccagcgtcggcctgaccagcgtcagccttggcgttatccgtgctatggagcgcaaaggcgttcgtctgagcgtctttaagcctatcgcccagcctcgtgcgggtggcgatgcgccagaccaaaccactgccattgtgcgtgccaattccaatctgccagcggctgaaccgctgaagatgagtcacgttgaatctctgctctccagcaatcagaaagacgtgctgatggaagagatcatcgcgaactaccacgcaaatacccagaacgcggaagtggttctggttgaaggtctggttccgacgcgtaaacaccagtttgctcagtcactgaactacgaaatcgctaagactctgaacgcagaaatcgtgttcgtgatgtctcagggtaccgacacgcaggaacagctgaaagaacgtattgagctgacccgcagcagcttcggcggcgcgaaaaacgccaacatcactggcgttattgtcaacaagctgaacgcgcctgttgatgaacaaggccgtactcgccctgatctgtcagaaattttcgacgactcttccaaagcgaccgtcgtgaaagtggaccctgctcagcttagcgaaagcagcccactgccaattctgggcgcggtgccgtggagctttgatctgattgcaactcgtgcaatcgacatggcacgccacctgaacgctaccgtggttaacgaaggcgacattcagacccgccgcgtgaagtccgttaccttctgtgcgcgtagcattccgcacatgctggaacacttccgtgcaggttccctgctggtgacttccgcagaccgtccagacgtgctggttgcagcgtgcctggccgcgatgaatggcgtagaaatcggtgcgattctgctgaccggtgcatacgaaatggacgctcgtgtcagcaagctgtgcgaacgtgctttcgcgactggcctgccagtattcatggtgaacaccaacacctggcagacctctctgagcctgcagagcttcaacctggaagttccggttgacgaccatgagcgtatcgagaaagttcaggaatacgttgcaagcttcatcaatgctgagtggatcgaatccctgacagcgacctctgagcgcagccgccgtctgtctccgccagccttccgttaccagctgactgagctggcacgtaaagccggcaaacgcgttgttctgccagaaggtgatgagccacgtaccgttaaagcagctgctatctgcgctgagcgcggaatcgcgacctgcgtactgctcggtaaccctgatgaaattacccgcatcgccgcatctcaaggcgttgaactgggttcaggtatcgaaatcgttgatccagaagtggttcgcgaaagctatgttgcccgtctggttgagctgcgtaagagcaaaggcatgaccgaagccgttgcgcgcgaacagctggaagacaacgtggtgctgggtacgctgatgctggaacaggatgaagttgatggcctggtttctggtgcggttcataccactgcgaacaccattcgtccgccgctgcagttgatcaaaacggcaccaggcagttcgctggtttcatctgtgttcttcatgctgctgccagaacaggtttatgtttacggtgactgcgcgatcaacccagatccaaccgcagaacagctggctgaaatcgcgattcagtctgcggattccgcgattgcctttggtatcgaaccacgcgttgcaatgctttcctactctaccggcacttcgggtgcaggtagcgatgtagagaaagtgcgcgaagcgacacgtctggcacaggaaaaacgtcctgatctgatcatcgacggtccactgcagtatgacgccgccgtgatggctgatgtggcgaaatccaaagcgccaaactctccggttgcgggtcgcgctaccgtgttcatcttccctgatttgaacaccggtaacaccacctataaagcggtacagcgttctgccgacctgatctccattgggccgatgctgcaaggcatgcgcaaacctgtgaacgacctgtcccgtggcgcgctggtagacgatatcgtttataccattgcactgactgcgattcagtcttctcagcagcagtaa

SEQ ID NO: 1544 - DNA, 2139 bp, Cronobacter turicensis
gtgtcccgtatcattatgcttattcctaccggaaccagcgtcggcctgaccagcgtcagcctcggcgtgatccgcgctatggaacgtaaaggcgttcgtctgagcgtcttcaaacctatcgcccaacctcgtactggcggcgatacgccggaccagaccacgaccatcgtgcgcgctaatactaatctgccagccgctgaaccgctgcgcatgagccacgtcgagtcgctgctctccagcaaccagaaagacgtgctgatggaagagatcatcgctcgcttccatgaaaacaccaaagatgcagaagtggtgctggtggaaggcctggtgccgacccgtaagcatcagttcgcccagtcgctgaactatgaaatcgcgaagactctgaatgcggaaatcgtgttcgtcatgtctcagggcaccgacaccccggaacagttaaaagagcgtatcgaactgacccgcagcagcttcggcggcagcaaaaacgccaacatcaccggcgttatcgtcaacaaactgaacgcgccagtggatgagcagggccgtacgcgtccggatctctccgagattttcgatgactccaccaaagcgaaaatcatcaacatcgacgcgcagcatctgcaggccatcagtccgctgccggttctcggcgcggtgccgtggagctttgatctgatagccacccgcgctatcgacatggcccgtcacctgaacgcgaccatcgttaacgaaggcgatattaaaacccgccgcgtgaagtctgtgacgttctgcgcgcgcagcattccgcatatgctggaacacttccgtccgggctccctgctggtgacctccgcggatcgtccggatgtgttagtggccgcctgccttgccgcgatgaatggcgtagaaatcggcgccatcctgctgaccggcggttatgaaatggacgagcgcatcaacaagctatgtgaacgcgctttcgccaccggcctgccggtatttatggtgaacaccaacacctggcagacctcgctcagcctgcagagcttcaaccttgaagtgccggcagacgaccatgagcgcatcgaaaaagtgcaggaatatgtggcaagccacgtcagcgccgagtggatcgactccctgaccgccacgtccgagcgcagccgtcgtctctctccgccggcattccgctaccagttgaccgagcttgcgcgtaaagcgggcaaacgcgtcgtgctgccggaaggcgacgagccgcgtaccgtgaaagcggcggccatctgcgccgagcgcggcatcgcgacctgcgtgctgctgggtaacccggacgaaatcagccgcgtggcggccgcacagggcgtagaactgggcaccggcatcgaaatcgtcgatccggaagtggtgcgtgaaagctacgtggcgcgtctggttgagctgcgtaagagcaaaggcatgaccgaagcggtcgcccgcgaacagctggaagataacgtggtgctcggcacgctgatgctggagcaggacgaagtcgatggtctggtatccggtgcggtacacaccaccgcgaacaccatccgtccgccgctgcagctcatcaaaacggcgccgggcagctcgctggtctcctccgtgttcttcatgctgctgccggaacaggtttacgtttacggcgactgcgcaatcaacccggatccgactgcagaacagctggccgaaatcgcgattcagtccgccgactccgctgccgctttcggcatcgaaccgcgcgtggcgatgctctcctactccaccggcaactccggtgcgggcagcgatgtagaaaaagtgcgtgaagccaccaaactggcgcaggaaaaacgcccggatctggttatcgacggcccgctgcagtatgacgccgccgttatggctgacgtagcgaaatccaaagcgccgaactcgccggttgcaggccgcgctaccgtgttcatcttcccggatctgaacactggtaacaccacgtacaaagcggtacagcgctctgccgacctgatctccatcgggccgatgctgcagggtatgcgcaaaccggttaacgacctctcccgcggcgcgctggttgacgatatcgtctacaccatcgcactgacggcgattcaggcgtcacagcagtaa

SEQ ID NO: 1545 - DNA, 2142 bp, Escherichia coli
gtgtcccgtattattatgctgatccctaccggaaccagcgtcggtctgaccagcgtagcttggcgtgatccgtgcaatggaacgcaaaggcgttcgtctgagcgttttcaaacctatcgctcagccgcgtaccggtggcgatgcgccgatcagactacgactatcgtgcgtgcgaactcttccaccacgacggccgctgaaccgctgaaaatgagctacgttgaaggtctgctttccagcaatcagaaagatgtgctgatggaagagatcgtcgcaaactaccacgctaacaccaaagacgctgaagtcgttctggttgaaggtctggtcccgacacgtaagcaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgccaaaaacaccaacatcaccggcgttatcgttaacaaactgaacgcaccggttgatgaacagggtcgtactcgcccggatctgtccgagattttcgacgactcttccaaagctaaagtaaacaatgttgatccggcgaacgtgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgccagcattccgcacatgctggagcacttcgtgccggttctctgctggtgacttccgcagaccgtcctgacgtgctggtggccgcttgcctggcagccatgaacggcgtagaaatcggtgccctgctgctgactggcggttacgaaatggacgcgcgcatttctaaactgtgcgaacgtgctttcgctaccggcctgccggtatttatggtgaacaccaacacctggcagacctctctgagcctgcagagcttcaacctggaagttccggttgacgatcacgaacgtatcgagaaagttcaggaatacgttgctaactacatcaacgctgactggatcgaatctctgactgccacttctgagcgcagccgtcgtctgtctccgcctgcgttccgttatcagctgactgaacttgcgcgcaaagcgggcaaacgtatcgtactgccggaaggtgacgaaccgcgtaccgttaaagcagccgctatctgtgctgaacgtggtatcgcaacttgcgtactgctgggtaatccggcagagatcaaccgtgttgcagcgtctcagggtgtagaactgggtgcagggattgaaatcgttgatccagaagtggttcgcgaaagctatgttggtcgtctggtcgaactgcgtaagaacaaaggcatgaccgaaaccgttgcccgcgaacagctggaagacaacgtggtgctcggtacgctgatgctggaacaggatgaagttgatggtctggtttccggtgctgttcacactaccgcaaacaccatccgtccgccgctgcagctgatcaaaactgcaccgggcagctccctggtatcttccgtgttcttcatgctgctgccggaacaggtttacgtttacggtgactgtgcgatcaacccggatccgaccgctgaacagctggcagaaatcgcgattcagtccgctgattccgctgcggccttcggtatcgaaccgcgcgttgctatgctctcctactccaccggtacttctggtgcaggtagcgacgtagaaaaagttcgcgaagcaactcgtctggcgcaggaaaaacgtcctgacctgatgatcgacggtccgctgcagtacgacgctgcggtaatggctgacgttgcgaaatccaaagcgccgaactctccggttgcaggtcgcgctaccgtgttcatcttcccggatctgaacaccggtaacaccacctacaaagcggtacagcgttctgccgacctgatctccatcgggccgatgctgcagggtatgcgcaagccggttaacgacctgtcccgtggcgcactggttgacgatatcgtctacaccatcgcgctgactgcgattcagtctgcacagcagcagtaa

SEQ ID NO: 1546 - DNA, 2130 bp, Candidatus Hamiltonella defensa 5AT (Acyrthosiphon pisum)
atgttaattccaatcggtactggtattggtttaagtagtgtaagtctaggtgtgatccgatcgatggaacaaaaagggatacgattaactttatttaaacctatttctcaatcaagctctaataaaccagataaaacgactgcgattattcgggcgcattctaatctcaatgtgggaaaatcgcttaatcttgattatgttgaaagcctactcagaaccagccaacaaaatgttttgatggaagaaattcttgcgcattatcacgaaagtaccttggataacgaggtggtattgatagaaggattggtttctatacgccagcatcagttcgttaatatgttaaatgaacaaattgcaagaacgttgaatgccaaaataatttttgtgatggcgatggggaatgattcacccgttcaactgagagagcgtattgaattggctcgttcgaattttggtggcagtaaaaacaaaaatattgtaggtgtcatcatcaataaattaaatgccccaatggatgaacagggtcgtactcgccctgatctatcagacatttgtgatggttcaagaaaaacaaatttgaaaaatattgatattgaacatcttcaaaaccatctccctctccctttactggcttgtattccatggcatgctgatctgatagcgattcgcgctaccgatatcgcaaaacatcttggtgcccaagtgatcaatgaaggtgatattcagaccagaagaatcaggtcttttaacttttgtgctcgcagtctccctaatatgttgcaatattttcgagccggcgctttattagtgacctctgcagatcgctcggatgttttagtggctgcttgcctggcagcgatgaatggggttgaaattggggcaattcttctcacagggggttacattatagaccccagtgtgaatcagctatgccagcaggcctttcaaactggcttacccgtttttaaggtggagacaaatacttggcaaacttctttgaatctacaaagttttagtttagaaattccggttgacgatcatgaacgtattgaaaaagtgcaaaattatgtcgctgaccatattagcaatcaatggatttgttctttaactgctttttcagagcgaacacaccgtttatctccccctgcgttccgttatgagttaacggagcgtgcacgtaaagccaataaacggatcgtattacccgaaggggatgagcctcgtacgatcaaggccgcggctttttgtgccgaacgagggattgcacgttgcgtattattgggcaatccagaggaaattcaccgaattgcagcggcacaaggtgtggaattaggccaagagattgagatcatagatcctgtgacgacccgtgaaaattatgttgcacgccttgttgagctgagaaagaataaaggcatgacggaagtggtcgctcgtgagcaattacaagataacgttgttttgggcaccttgatgcttgaacgagatgaagtggacggtttagtttcaggagcagtacatactacagcccatactattcgccccgcattacaactcatcaaaacagccccagggaattcactggtttcttctgtgtttttcatgttgttgccggatcaggtgctggtgtatggtgattgtgcgattaatcccgatcccacggcggagcaacttgctgaaattgcgattcaatccgcggattcagcggctgcttttggcattgagcctcgtgtcgcaatgatctcttattctacaggaaattcaggcaccggcagtgacgtagaaaaagtcagagaagccactatgatggcacaaaaaaagcgccctgatctgatgattgatgggccattacaatacgacgccgctattatggcagatgtggctcagtctaaagcacctcattctcctgttgcaggtcaagctaccgtttttatcttccctgatctgaatacgggcaatacgacctacaaagcggttcaacgctctgctgatttagtctcgattggccctatgctgcagggcatgcgtaaaccgctgaacgatctttcacgtggtgcactagtggaggacattatttacaccatcgcattaacggccattcaagccgtatcgattaaaaatggaacttaa

SEQ ID NO: 1547 - DNA, 2145 bp, Pectobacterium carotovorum subsp. brasiliensis PBR1692
atgccccgtaccattatgctcatccctactggcacaggtgtggggctgacgagcatcagcctcggccttattcgcgcaatcgaacgtaaaggtgtacgcctgagtatcttcaagcctgtcgcgcagccgcgcgacagcaacgacatcacggatctaaccacggcaatagttcgcaccagttcccgcctccccgttgcggaacctcttacgatagcgcatacagaatcactgctgtcacagcagaaaaaagagattttactggaaactattgttgcccgttatcacgaaaacatccgccatgccgatatcgtgctggttgaaggtctggtaccgacgcgtaagcacccattcgccgcatcgcttaatatggaaattgccaataccctgaacgcggaagtcattcttgttctgtcgcaaggttctgacaatgccgatgaactaaaagcacgcattgaactggcgcgaagcagtctgaaacccaataagggaacctccatcattggtgccatcgtcaataagctcaacgcgccagttgatgaacaaggccgtgcacgaccggatctttcgcggatttttgacgatgcaaccggagctaacgtcgtcagtctggacataaagcggctgaaggcgatgagcccacttcctttactcggtgcggtgccatggaactttgatctgatttcaactcgggtcagcgacattgtcagccatttgcaggctgccgcaatccacaccggcgatcgacagactcgccgcataaaatcgatcgtcttctgcgcgcgcagcgtgccgcatatgttgcagtatttccagcctggcgcactgctggtgacatcagccgatcgtcccgaagtcattattgccgcctgtctggctgcgatgaacggggtggaaatcggcgctcttctcctcaccggaggcgagccaatcccgagcagtatccatacgttgtgcgaacgtgcttttgccactggcctacccgtctatctggtacagagtaatacctggcaaacctctttggatttacagagctaccagccaacggtgcccgttgatgattacgagcgtatcgagcaggtatgcgactacatggcaaactacatcgaccccgtctggattgatacgctgagtgcggccaccgagcgtacgcatcgtctgtcaccaccggcgtttcgctatcagttaaccgaactggcgcgtcgcgcaggtaaacgaatcgtgttacccgaaggggatgaaccacgtacaatcaaagcggcggccatctgtgccgaacgcggcatcgctcactgtgtattattaggcgatccggaaaatattctgcacatcgcggcatctcaaggcgtatcgctgggcgatggaatcacgattatcgatccccacgttgtcagggaacgctatgtgccacgcctggttgagttacgaaaaaacaaaggaatgacggacatcgtcgcccgcgaacagttggaagataatgtcgtacttggcacgctgatgcttgaacaagacgaagtggatggtctggtttctggcgcggtacacacgacagccaacacgatacgccctccactacagctgattaaaaccaggccggaaagcgctctggtatcctccatcttctttatgctactgcccgagcaggtattggtgtacggcgactgcgcgatcaatcccgatcctacggcagagcaactggccgagattgcgattcaatccgcagactcagcggcgctattcggcattgaaccacgcgtggcgatgatatcctattcgaccggcaattccggctctggcaacgatgtcgaaaaagtgagggaggcgacgcggatagcacaggcgagacggccggatatgattattgatggtccactgcaatatgatgccgcaattatggcggatgttgcccgcgcgaaggcaccggactcaaaggtagcagggaaagcgaccgtttttattttcccggatttgaataccggcaataccacctacaaagccgttcaacgttccgccgacctgacctctatcgggccaatgctgcaagggatgcgcaaacccgtaaacgatctttcacgcggggcgctggttgacgatatcgtctacaccatcgcgctgactgcgattcagggcgcgcagcacaacccttaa

SEQ ID NO: 1548 - DNA, 2148 bp, Photobacterium sp. SKA34
gtgtcccgtactattatgcttgttccagttggcgctggcgttggtctaacaagtgttagccttggtgtacttcgtgcaatggaacgcaaaggcgttcgcgtttctttctttaagcctattgcgcaaccgcgtaaaggtggcgatcaaccagatctaacaacaacaattattagtgctaacagcgatatgaaaattgctgagtcattctcaatggcaagcgctgaagaattgatccgtaacgacaaaactgatgttcttctagaagacattgttgcacgctttaaagcggcaacagcagatgctgacgtaacgctaatcgaaggtctagttgctactcgtaagcacccttttgcaaaccaaatcaactttgaaattgcaaaaacactagatgctgaaatcgtgttcgttgtatctccaggtactgataacccagctcaacttaaagagcgtatcgaagtagcatgttctaacttcggtggtatcaagaacaaacaaatctctggtgttattgttaacaaacttaacgcaccagttgatgctgaaggtcgtactcgtccagatctttctgagatctttgatgacgcagaaggtactgttccttcaaatgttgaaatcatgcaagtgttcaactcaagcccaattcgtgtactaggttgtgcaccttggagcgcagagctaatcgctacacgtgcaactgatattgctcagcacctaaatgctgaaattatcaatgcaggtgatatcgaaactcgtcgtattaagagcatcactttctgtgcacgttctatccctaatatggttgagcacttccgtccaggttcactgcttgtaacgtcagctgaccgtccagacgtaatcgttgcagcatgtcttgctgcaatgaacggcgttgaactaggtgcacttcttctaacaggtggttacgacctaccaaaacctgttatggatctatgtgagcgcgcgttctcgactggtcttccagtaatgacggctcaaggtaacacttggcagacctctctaaatctacagagcttcacgctagaagtacctgcagacgataaagagcgtgtagagctagttaacgagtacatggcaagccacatcgacggtaactggattgagtctctaactgaaggttcaaaccgtgagcgtcgccttagcccaccagcattccgttaccagttaactgagctagctcgtaaagcggctaagcgtatcgttcttcctgaaggtgacgagccacgcacagttaaagctgcagctatctgtgctgagcgcggtatcgcggaatgtgtacttctaggtaaccctgatgaaatccgtcgcgttgctgagcaacaaggcgtagttcttggtactggcgtaacgatcatcaactctgacgaagtacgtgaaaactacgttgctcgtttagttgagctacgtggcgcgaaaggtatgactgacgttgttgctcgtgagaagctacaagattcagtattcctaggcacaatgatgcttgagaacaacgaagttgacggtctagtgtctggtgctgttcacactacagcaaacactattgttcctccgttccaaatcatcaagactgcacctgatgcatctatcgtatcttctgtattcttcatgcttctaccagaccaagtattggtttacggtgactgtgcgatcaacccagatccaacagctgagcaacttgctgaaatcgctatccaatctgcagattctgcaaaagcatttggtatcgacccacgtgttgctatgatctcttactctactggtgaatcaggtaagggtgcagacgtagataaagtacgtgaagcaacgaagatcgctcaagagaaacgtccagatctagtgatcgatggtcctcttcagtacgatgctgcaatcatggaaaacgtagctgcttctaaagcacctaactctccagtcgcaggtaaagcaactgtatttgtattcccagacctaaacactggtaacacaacatacaaagcggtacagcgttcagcagatctagtatctatcggtccaatgcttcagggcatgcgtaagccagttaacgacctttctcgtggcgcactagtagacgatatcgtttataccgttgcactaactgcgattcaggcagaacaagctacagaaaaataa

SEQ ID NO: 1549 - DNA, 2157 bp, Photobacterium profundum SS9
gtgtcccgtactattatgctcatcccagttggcgctggtgtcggtctaacaagcgtaagcctcggtgttttacgtgcaatggaacgcaaaggcgttcgtgtttctttctttaagcctatcgcacagccacgtagtggtggtgagcaaccggatctgactacaacgatcatccgtgctaacagcgatatggaaattgcagaaccatttacaatggcacgtgccgaagaacttcttcgtaacgaccaaagtgatgtactgctagaagacatcgttgcgcgtttcaaagcatcaacagctcaatctgaagtagcattaatcgaaggtcttgtacctacacgcaaacacccatttgcgaaccagattaactatgaaatcgctaaaacgctgggtgcggaaatcgtattcgttattgcgcacggtactgataaccctgcacaactaaaagagcgtatcgaagtagcatgttctaacttcggcggcattaaaaacaagcaaatctcaggcgttattgttaataaactaaacgcacctgtagatgctgaaggccgtactcgcccagacctatctgaaatctttgacgatatagacggcacaactattccgctaaacgttgaagtaatgcaagtatacaactctagccctattcgtgtacttggttgtgcgccatggagcccagagctaattgcaacacgttcaacagatattgcagcgcaccttaacgctcaaatcatcaacgaaggtgatattgcgactcgtcgtataaagagcgttactttctgtgcacgctctattccgaacatggttgagcacttccgtcctggttcactactagtgacttctgcagaccgtcctgacgttatcgttgcggcatgtcttgcagcaatgaacggcgttgaaatcggtgcacttcttctaactggcggctatgagctacctaagccagtgatggatctttgtgagcgtgcattcgcaacaggcttacctgtgatgactgcactgggtaacacttggcagacatctctgaatcttcagagcttcagccttgaagtaccagcagacgataaagaacgtgtagaattcgttaatgaatacatggctagccacatcgatggtcagtggattgaatcattaactgaaggttctgctaaagagcgtcgtctaagcccaccagcattccgttatgaattaacagagctagcgcgcaaagcagctaagcgtgttgttcttcctgaaggtgacgaaccacgtaccgttaaagctgcagctatctgtgctgaacgcggtattgctgagtgtgttcttcttggtaacccagaagaaatcaagcgtgttgctgaacagcaaggcgttacactaggtgctggcgttacaatcatcgattctgaatcggtacgtgaaaactacgttaaacgtcttgttgagcttcgcggtgcgaagggcatgactgacgttgttgcacgtgaaaaacttaaagattctgttttcctaggcacaatgatgcttgaggcaggtgaagttgatggtcttgtttctggtgcggttcataccacagcaaacacgattgttcctccattccaaatcatcaaaacagcaccagatgcttctatcgtatcttctatcttcttcatgcttctgcctgatcaagtactggtatacggtgactgtgcaatcaacccagatccaaatgctgaacaacttgctgaaatcgcaattcaatctgctgattctgctaaagcattcggtatcgaacctcgcgttgctatgatttcatactctactggtacatctggtaagggtgctgatgttgataaagtacgtgaagcgacacgcattgctcaagagaaacgtcctgatctaatcatcgatggtcctctacagtacgatgctgcaatcatggaaaatgtagccgcttctaaagcgcctaactctcctgtagcgggtaaagcaacagtattcgtattcccagacctaaacacgggtaacacgacgtacaaagcggtacagcgttcagctgatctagtttctatcggccctatgcttcagggcatgcgtaagccggtaaatgacctttctcgtggcgcactagtagacgatatcgtatacacagttgcactgactgcgattcaggctaagcaaactgagaacgctacgaagtaa

SEQ ID NO: 1550 - DNA, 2160 bp, Grimontia hollisae CIP 101886
gtgtcccgtactattatgctcattcccatcggcacaggtgtcggtctgaccagcgttagcctgggcgtactgcgtgcgatggaacaaaagggccttcgagtttcatttttcaaacccattgcccaacctcgccacggcggcgaccaacctgacctgacaaccaccatcatcgaagccaacagcgacatgaaagtggcagagccactgaccatggcaaacgctgaagcgctgatccgtactgatcagacagatgtgttgatggaagagatcattgcccgctttaaagaagcaactgcagaagcagaagtggcgctgattgaaggtctggtaccaacccgcaaccacccatttgcgaatcaggtcaactacgaaatcgcaaaaacactggacgcggaaatcgtgttcgtcaccacccctggtaccgataaccctgcgcaactgaaagagcgtatcgaggttgctgtctctaacttcggtggtatcaagaacccgaacattgcgggtgtgatgatcaacaaacatggcgcaccggttgacgaacaaggccgtacccgccctgacctgtctgatatcttcgatgacaacaatactgccaaaggcagcaatgttgaagtgatggagattttcaactccagccctatccgcgttctgggttgtgtgccttggagcattgacctgatcgccacccgtgcaagcgatctggcgaaacacctgaatgctgaaatcatcaacaaaggggatatcaatacccgtcgcatcaagagcatcacattctgcgcgcgctcaatccctaacatgattgaacacttccgcgcaggctccctgctggtaacctctgctgaccgtcctgacgttatcgtcgcagcctgtctggcagcaatgaatggtctggaaatcggtgccctgctgctaaccggcggctacagcatcccagaacagctgcacagcctgtgtgagcgcgcgttcgcagctggcctgcccgtgttcacgactgcgggtaacacctggcagacgtcactgaacctgcaaagcttcagcctggaagtaccggctgacgataaagagcgtgttgaattcgttcaaaaccacgttgcagcacacgttgacggcaactggattgaatcactgtctgaaggctctgcacgtgaacgtcgcctgagcccaccggcattccgttaccagttgactgagctggcacgtaaagcggccaaacgtatcgtgctgcctgaaggtgatgaaccacgcaccgtgaaagcggcagccatctgtgctgagcgtaaaattgcggaatgtgtgctgctgggtaacccagacgaaatcagacgtgttgctgagcaacagggcgtgacactgggcgcaggtgtagaaatcatcgatccagacaccgtgcgtgagaaatacgttgcacgtctggttgagctgcgtaagaacaaaggcatgactgaagttgtggcccgtgagcaactggaagacaccgtggtactgggtaccatgatgctggaagcaaacgaagttgatggcttggtttccggtgctgttcacactacggcgaacaccatccgtccgccgctgcaaatcatcaagacagcaccaaacgcgtctctggtgtcttctgtgttcttcatgctgttgcctgatcaggttctggtatacggtgactgcgcaatcaacccagatccaaacgcagaacagctggcggaaatcgctatccagtctgcagattcggcgaaagcattcggcattgagcctcgcgttgccatgatctcttactctaccggtacatccggccagggtgcagatgttgagaaagtgcgtgaagcgacacggattgcccagcagaaacgtcctgatctgatgatcgacggtcctctgcagtacgatgccgctatcatggagaacgtggcagcatctaaagcgcctaactccccagtggcaggtaaagcgaccgtattcgtgttcccagacctgaacaccggtaacaccacgtacaaagcggtacagcgttcagcagatctggtttccatcggtccaatgctgcaaggtatgcgcaagcctgttaacgacttgtcccgcggtgcactggtagacgacatcgtttacaccgttgcactgacagccattcaggcaaaacaagccgaagaagcagaagcggcacaataa

SEQ ID NO: 1551 - DNA, 2127 bp, Vibrio furnissii CIP 102972
atgcttatccctatcagtactggcgttggcttgaccagcgtgagcatgggtcttttgcgcgccatggagcgtaaaggtgtaagcgtttctttctataagccaatcgcacagcctcgcagcggtggcgaccaacccgacctgacttcaacgatcgtcggtcacaacagcgacatgaaaattggtgagccaatgtcaatgtcgtctgctgaagcgctgatcggtggcgaaaaaatggacgttctgctggaaacagtggttgaacgttacaaccaaatcaactcatcagaagtgacgctggttgaaggtctagttccaactcgtaaacacccattcgccaaccaagtgaacgcggaaatcgcaaaaactttgggtgctgaaattgtgttcgtcgcaacgcctggcacgcacaaccctgcgcagctgaaagagcgtatcgaagtggcatgctctaacttcggcggtacgaagaacaagaacatttctggtgtgatcatcaacaaactgaacgcaccggttgatgaagctggccgtacccgtccagacctgtctgaaatctttgacgattctgacagcgcaaaacaagccaacatcgaagtgatgcagatcttcaactcaagcccaatccgtgttctggggtgcgtgccttggaatgttgacctgatcgcaacacgtgcgatcgacatggcaaaacacctgaatgctgacgtagtcaacgaaggcgacatcaacacacgtcgtatcaagagcatcacattctgtgcgcgttcaatcccgcacatgattgagcacttccgtccaggttcactgctggtgacttcagcagaccgcccagacgtgatcgtggcagcatctcttgctgcgatgaacggcgttgaaatcggtgccgtactgctgactggcggctacgatattccagaagaaatcgtgagcctgtgtaaaccagcgtttgaaactggcctgccaatcttcaaagcacaaggtaacacatggcaaacatcgctgaacctgcaaagcttcagcctagaagtgcctgctgacgataaagagcgtatcgaatttgtttgtgaccacgttgcaagccacatcgaaggcgcttggatcgaaactctgactgaaggtactcaaggtacgcgtcgtctgagcccaccagcattccgttaccaactgactgagtttgcacgtcgtgccaacaaacgtatcgtgctgcctgaaggcgacgaaccacgtacagttaaagcggcagccatctgtgctgaacgcggtatcgcgacttgtgtgctcctaggtaacccagatgaaatccgccgtgttgctgcgcaacaaggtgttgagctgggcgctggcgtagaaatcatcgatgcagattcagttcgtgaaaactacgtggctcgcctagttgaactacgtggcgcgaaaggcatgactgaggttgtggcgcgtgaaaaactggaagactccgttttcctaggcaccatgatgctggaagcgaacgaagtggacggtctggtttctggtgcggttcacaccacagcaaacaccatcgttcccccattccagatcatcaaaacagcaccgaatgcatcgatcgtatcgtctgtattcttcatgctgctgcctgaccaagttctggtttacggtgactgtgcaatcaacccagatccaacagctgagcaactggctgaaatcgcaatccaatctgcagattctgcagcggcattcggtatcgacccacgcgtagcgatgatctcatactctaccggtacatcaggtaaaggtgcagacgttgataaagtgcgtgaagcaacacgtatcgcacaagaaaaacgtcctgatctgatcatcgacggtccactgcaatacgacgcagcgatcatggagaacgtggcagcttctaaagcacctaactctccagttgcaggtaaagcaactgtattcgtattcccagacctgaacacaggtaacaccacttacaaagcggtacaacgttcagcagacttggtttcaatcggtccaatgctgcaaggcatgcgtaaacctgtgaacgacctgtctcgcggcgcgctggttgacgacatcgtctacaccatcgctctgactgcgattcaagcagaccaagagcaaaaataa

SEQ ID NO: 1552 - DNA, 2145 bp, Vibrio metschnikovii CIP 69.14
atgtcccgtactattatgcttgtcccaatcagtgccggtgttggtttaaccagtgtgagcatgggtcttttgcgcgccatggagcgtaaaggtgtaagcgtttctttttacaaaccaatttcacagccacgtagcggtggcgatcagccagatttaacatcaaccattattcgtcatagtagcgatatcaaaattgctgaaccaatggctatgtcagccgccgaagcgctgattggcggcgaaaaaatggatgtactactggaaacggttgttgaacgctataaccaaattattgttgatgccgaagtcacgttaatcgaaggtttagtcccaacgcgtaagcatccttttgcgaaccaagttaacgcagagattgctaaaacgttaggcgctgaaattgtcttcgttgccacgcctggtactgataatccaactcagctcaaagagcgtattgaagtcgcttgctctaactttggcggcactaagaataaaaacatctctggtgtggttattaacaaactcaatgcgccagtcgatgatgcgggtcgtactcgtccagatttgtcagagatttttgacgatgccgatggtgcaaaacaggccaaccttgaagtaatgcaaatcttcaacagtagcccaattcgcgtacttggttgcgtgccatggagcattgaccttatcgcgactcgtgcgattgatatggcgaaacatctcaaagccgaaatcgttaatgaaggtgatatcaacagtcgacgcattaagagcatcactttctgtgcacgctctatcccgcatatgattgagcactttaaaccaggctcattattagtgacttcagcagaccgtcctgacgttattgttgctgctgctttagcggcgatgaatggcgtagaaattggtgccgtattgctgaccggtggttacgatattcctaaagagatcgctaacctatgtaagcctgcttttgacactggcctaccgattttcaaagcgcaaggcaatacttggcaaacctcattgaacctacaaagctttagccttgaagttccagcggatgataaagaacgcgttgagtttgtcagtgaacatgttgctagccacattgatggcccatggattgattcgctgaccgaaggcactcaagcaacacgtcgtttaagcccgccagcgttccgttatcaactgactgaatttgctcgtcgtgctaacaaacgtatcgtgctaccagagggtgatgagccacgtaccgttaaagccgcggcgatctgtgcagagcgcggtattgcaaaatgcgtactgcttggtaacccagaagagatcaagcgcgttgctgcattgcaaggtgttgagcttggtgcaggcgttgaaattattgacgctgcagccgttcgtgaaaattacgttgctcgtttggttgagctgcgtggcgcgaaaggcatgacagaagtcgtcgctcgtgaaaaactggaagactcggtattcctcggcactatgatgcttgaagcgaatgaagtcgatggtcttgtttctggtgcggttcacaccacagccaataccattgttccaccattccagatcatcaaaactgcaccgaacgcttctatcgtctcttcggtgtttttcatgctgctgcctgatcaagttttggtttacggtgactgtgcgattaacccagatccaactgctgaacaattggcggagatcgcgattcaatcggcagactctgcggcagccttcggtattgagcctcgcgtcgcgatgatctcttactcaaccggcacctctggtaaaggcgcggatgtggataaagtgcgcgaagccactcgtcttgctcaagagaagcgtcctgatttaatcattgacggacctctacagtacgacgctgccatcatggaaaatgtcgcggcttctaaagcaccgaattctccagttgcgggtaaagcaacggtgtttatcttcccagatctgaacacgggtaacaccacttataaagcagtacagcgttcagcggatctggtttctatcggtccaatgctgcaaggcatgcgtaagccggttaacgacttatcacgtggtgctttagtggacgatatcgtctacaccatcgccttaaccgcgattcaagcagaccaagagcaaaaataa

SEQ ID NO: 1553 - DNA, 2166 bp, Vibrio sp. AND4
atgtctcgtactattatgcttatccctgcaagtgctggtgttggtctaactagcgtaagtatgggtgttcttcgcgcaatggagcgcaagggcgttaaggtttctttttacaaaccaatttcacagccacgttctggcggtgatcaaccagatctaacctcaactatcgttggctgcaacagcgatatgaagataggtcaaccactagcgatgtctgttgctgaaaacctcattggtaacgacaacatggacgagctgctagaaaccgttgtcgagcgttacaaccaaatcaacaaagatgcggacgtaacacttatcgaaggtctagtgccaactcgtaagcacccattcgctaaccaagtgaacgcagaaattgcagcaacacttggcgcagaaatcgttcttgtagcaaccccaggtactgataaccctgctcagcttaaagagcgtatcgaagtagcatgttctaacttcggcggcactaaaaacaaaaatatctctggcgtaatcatcaacaagctaaacgcacctgttgacgaggcgggccgtactcgccctgacttatctgaaatctttgacgatgcagacagcgcgaagcaaaacgaaatgaaagtgatggaaatcttcaacacttcaccaattcgtgtgctgggctgtgtaccatggagcatagatcttatcgcgactcgtgcgaccgatatggctaagcacctgaacgccgacatcatcaacgaaggtgagatcaacactcgtcgaatcaagagcatcactttctgtgcacgatctctgccaaacatgattgcgcacttcagaccaggctctctcctagtcacttctgctgaccgtccagacgttattgttgcagcatcacttgcagcaatgaacggtgttgacatcggtgcgatactgctaactggcggttacgacattcctgaagaaattgaaggtctgtgcaaaccagcattcgaaacaggtctacctatcttcaaagcacaaggtaacacttggcagacctctctgaaccttcagagtttctctatcgaagttcctgcagatgataaagagcgtattgagttcatcaacgaacacgttgctggtcacatcgacggtaactggatcgagtctatgactgaagggactcaaaagtcccgtcgtctcagcccaccagcattccgttaccagttaacggaatttgctcgcaaagctggcaagcgtatcgttcttcctgaaggcgacgaaccacgtacagttaaagcggcagcgatctgtgctgaacgcggtattgctgagtgtgtgcttctcggtaacccagacgaaatccgtcgcgttgcggagcagcaaggcgtaacactaggtgccggcgtaactatcatcaactctgatgaagttcgtgaaaactacgtggctcgtcttgttgaactgcgtggcgcgaaaggtatgactgaagttgttgctcgcgagaaactgcaagattcagtattcctaggcacaatgatgcttgagaacaacgaagtagatggtctagtttctggtgcggttcacaccacagcaaacactatcgttcctccgttccaaatcatcaagactgcacctgatgcgtctatcgtatcttctgtattcttcatgctactaccagaccaagtattggtgtacggtgactgtgcgatcaacccagatccaacagcggaacagcttgctgaaatcgctatccaatctgctgattctgcggcagcattcggtatcgacccacgtgtagctatgatctcttactctaccggtgaatctggtaagggtgcagacgtagataaagtacgtgaagcaactaagattgctcaagagaagcgtccagatctagtgatcgacggtcctctacagtacgacgcagcaatcatggaaaatgtggcagcttctaaagcgcctaactctccagtagcaggtaaagcgacagtattcgtattcccagacctaaacacgggtaatacgacttacaaagcggtacaacgttcagctgacctagtatctatcggtccaatgctgcaaggtatgcgcaaacctgtaaacgatctctctcgcggtgcactagtagacgatatcgtgtacacagttgctctaactgcgattcaggcagatcaagctgaccaagctcgcgaaaaagtagttaactaa

SEQ ID NO: 1554 - DNA, 2145 bp, Vibrio vulnificus YJ016
atgtcccgtactattatgcttatccctgcaagtgctggtgttggtcttactagcgtaagcatgggtgttcttcgcgctatggagcgcaaaggcgttaaagtttctttctacaagcctatcgcacaaccacgtagcggcggtgatcttcctgatctcactaccactatcgttggcgcaaacagcgatatgaagattggcgaacccctattgatgtctgttgctgagaacctaatcggtaacgacaacatggacgaactgctagaaacggttgtagaacgttacaaccaaattaataaagatgcagacgttacgctaatcgaaggtcttgttcctactcgtaagcacccatttgctaaccaagtgaacgcggaaatcgcagcaacacttggtgctgaaattgttcttgtggcgaccccaggcactgacaacccagcacagctaaaagagcgtatcgaagtggcttgttcaaacttcggtggcacgaaaaacaaaaacatctctggtgttatcatcaacaagctaaacgcgccagttgatgaagcaggccgtacgcgtcctgatctatcagagatcttcgatgacgcagacagcgcgaaacaaaaccagctagaagtgatgcaaatcttcaactctagcccaattcgcgttctaggttgcgtgccatggagcatcaacctgattgcaactcgtgcaatcgatatggcgaagcacctgaaagcagaagtgatcaacgaaggcgacatcaacactcgtcgtattaagagcatcaccttctgtgcacgttctctgccacacatgattgagcacttcaaaccaggctcactgctggtgacttctgctgaccgtccagacgttatcgttgcggcttctctagcagcaatgaacggcgtggaaatcggtgcggtacttctgactggcggttacgacattcctacagagatcgaaaacctatgtaagccagcgtttgaaagtggccttccaattttcaaagcacaaggtaacacttggcagacttcgctcaatctacagagcttcagcctagaagtacctgcagacgataaagagcgtatcgagttcatcaacgaccacgttgcgggtcacatcgatggcaactggattgagtcaatgacggaaggtactgagcgttctcgtcgcctaagtcctccagcattccgttaccagttgactgaacttgctcgtaaagcgggtaaacgcatcgttcttcctgaaggtgacgaaccacgtactgtgaaagcggcagcgatctgtgctgaacgcggtatcgcagaatgtgtactgctaggtaaccctgaagagatcaagcgcgtggcagcacaacaaggtgttgaactgggcgctggcgttaagatcatcgatgcagacgcgattcgcgaaaactacgttgctcgtcttgttgaactacgtggctcgaaaggcatgactgaagttgtggctcgtgagaagctgcaagattctgtgttcctaggcactatgatgcttgagaacgatgaagttgacggtctagtatctggcgcggttcacacgacggcaaacaccatcgttcctccgttccaaatcatcaagacagcaccaaatgcgtctatcgtatcttctgtattcttcatgcttctgcctgatcaagtactggtttacggtgactgtgcgatcaacccagatccaacggcagaacagcttgcagaaatcgcgattcaatctgctgattctgctgcagcctttggtatcgacccacgcgtagcaatgatctcttactctactggtgaatctggtaagggtgcagacgttgataaagtgcgtgaagcgaccaaactggctcaagagaaacgtcctgatctgatcatcgacggtcctctgcagtacgacgcagcgatcatggaaaacgtggcagcgtctaaagcgcctaactctccagtagcaggtaaagcgactgtattcgtattcccagacctcaacacgggtaacacgacttacaaagcagtacaacgttcagcagaccttgtttctatcggtccaatgctgcaaggtatgcgcaagccggtaaacgacctgtctcgtggcgcgctagtcgacgatatcgtctacaccatcgctctaactgcaatccaagcgactcaagatcagaaataa

SEQ ID NO: 1555 - DNA, 2145 bp, Vibrio shilonii AK1
atgtcccgtactattatgcttgtaccaactagcgctggcgtaggtcttaccagtgttagcatgggtgtattgcgtgctatggagcgcaaaggtgtgaacgttgcgttctacaagcctatcgctcagcctcgccacggtggcgatcaaccagacttaacttcaactatcgttggtaacagcagcgatatgaaagtgggccaaccacttccaatgtctgacgttgagaacctatacggtagcgaaaaagttgatgtactacttgagacaattgttgaacgttacaatcaagtaagcaaagacgctgaagtaacgcttatcgaaggtctagtaccgactcgtaaacacccatttgcgaacgcagttaacgcagaaatcgcaaaaacacttggtgcagagatcgtattcgtagcaacgccaggtactgacaacccaagtcagcttaaagagcgtatcgaagttgcatgtactaactacggtggtactaaaaacaagaacatctctggcgttatcatcaacaagctaaacgctcctgttgatgaagcaggccgtactcgtccagatctttctgaaatctttgatgacgcagacaccgcgcagcaagctaaccttgaagtaatgcaaatcttcaacactagcccaatccgcgttcttggctgcgtgccttggaagatcgatttaattgcaacgcgtgcaatcgacatggctcagcacctaaatgccgaagtaattaacgcgggcgatatcgagaagcgtcgtattaagagcatcacgttctgtgcacgttctctaccgaacatgatcgagcacttcaaaccaggttctctacttgttacttcagcagaccgtccagacgttatcgtcgctgcggcacttgctgcaatgaacggtgtagaaatcggcgctatcctattaacaggtggctacgatgttcctgttgaaattgctgacctaatcaagccagcactagacactggcctgccaatctttaaggctcaaggtaacacatggcaaacgtctctgaacctacagagctttagcctagaagtacctgcagacgataaagagcgtatcgagttcgttaacgagcacgttgctggtcacatcgacggtccatggattgactctttacttgaaggtactatcggtactcgtaagctaagcccaccagcattccgttaccagttaacagaacttgctcgtaaagctggcaaacgtatcgttcttcctgaaggtgatgagcctcgtacagttaaagctgcggctatctgtgctgagcgtggcatcgcggaatgtgtgcttcttggtaacccagacgaaatcaagcgcgtagctgcacaacaaggtgttgaactaggtgcaggtgttacaatcatcgattctgatgcggtacgtgaaaactacgttgctcgtctcgtagaactacgcggcgcgaaaggtatgactgaagttgtggctcgtgagaagctacaagactctgtttaccttggcacaatgatgcttgaagcaaacgaagtagacggtctagtatctggtgctgttcacacaacagcaaatactatcgttcctccgttccaaatcatcaaaacggctccgggtacatctatcgtatcttcaatcttcttcatgctgctgcctgatcaagtattagtgtacggtgactgtgcaatcaaccctgacccaacagctgagcaacttgctgaaatcgctattcaatctgcagactctgctgcggcattcggtatcgacccacgcgttgcaatgatctcatactctactggtgagtctggtaaaggtgctgatgtagataaagtacgtgaagcaaccaaactagcaaaagagaaacgtcctgatcttatcatcgacggtcctctacagtacgatgcagcgatcatggagaacgtagcggcttctaaagcacctaactctccagttgctggtaaagcgactgtatttgtattcccagatctaaacactggtaacacaacatacaaagcggtacagcgttcagcagacctagtttctatcggtccaatgctgcaaggtatgcgcaagccagttaacgacctttctcgtggcgcactagtagacgatatcgtgtacacagtagcactaactgcgattcaatcaggtcaagagcaaaagtaa

SEQ ID NO: 1556 - DNA, 2205 bp, Vibrio splendidus LGP32
ttgagcttttttatttccaatagtcaaaggtgttcgtcaatgtcacgtactattatgcttatccctacaagcgctggtgttggtcttactagtgttagcatgggtgttcttcgcgctatggagcgtaagggcgtaagtgtttctttctacaagccaatcgctcaacctcgtagcggtggtaaccagccagatttaacctctactatcatcagcgcgaacagcgacattaagattggtgagccaatcgcaatgacaaaagctgaagctttgatcggtagcgagaaaacggatgagcttcttgaatctgttgttgagcaatacaacaaaatcaacaaagacgctgaagtaacgctaatcgaaggcctagtccctactcgtaagcacccgtttgcaaaccaagtgaacgcagaaatcgcgaaaacgcttggcgcagagatcgtattcgttgcgactcctggtactgacaaccctacgcaacttaaagagcgtatcgaagtagcatgttctaacttcggcggtactaagaacaagaatatcaaaggcgtaatcatcaacaagcttaacgctcctgttgatgaagctggtcgtactcgccctgacctatctgaaatctttgatgatgcagacagcgctcagcaagcgaaccttgaagtaatgcaaatcttcaactctagccctatccgtgttcttggctgtgtgccatggagcatcgacctaatcgcaactcgtgcggttgatatggctaagcaccttaacgctgaaatcgttaacgaaggtgaaatctcaactcgtcgtattaagagcatcactttctgtgcacgttctctaccgcacatgattgagcacttcaaaccaggttcactgctagtaacttctgcagaccgtcctgacgttatcgttgctgcggctcttgctgcgaaaaacggtgttgagattggcgcaatcctactgactggcggttacgacatcccagaaagcattgctaacctttgtgcaccagcattcgcttcaggtctaccgatcttcaaagcgcaaggtaacacttggcagacgtctctaaacctacagagcttcaacctagaagttcctgcagacgataaagagcgtatcgagttcgttaacgatcacgttgcaagccacattgatggcccttggattgattctctatctgaaggtactcaaggcatccgtcgtctaagcccaccagcattccgttaccagctaactgaatttgctcgtaaagcggctaagcgcatcgttcttcctgaaggtgatgagccacgtacagttaaagctgcggctatctgtgctgagcgcggtatcgcaacgtgtgtacttctaggtaaccctgaagaaatccgtcgcgttgcagcacagcaaggtgttgagcttggcgctggcgttgagatcatcgattctgcatcagttcgcgaaaactacgtagctcgtctagtagaacttcgtggcgctaaaggtatgactgaagttgttgctcgtgagaagctagaagattcagtattcctaggtactatgatgcttgaagctggcgaagttgacggcctagtttctggtgctgttcacacaacggcgaacacaatcgttcctccgttccagatcatcaagactgctcctgatgcttctatcgtatcttcaatcttcttcatgcttctgcctgatcaagttcttgtatacggtgactgtgcgatcaacccagatccaacagctgaacagcttgctgaaatcgctatccaatctgcagattctgctgcggcattcggtatcgacccacgcgttgctatgatctcttactctactggtgaatctggtaaaggtgcagacgtagataaagtacgtgaagcaaccaaacttgctcaagcgaaacgtcctgatcttgtgatcgacggtcctcttcagtacgacgcagcaatcatggaaaacgtagccgcttctaaagcgccaaactctccagttgcaggtaaagcgacagtattcgtattcccagacctaaacacgggtaacacgacttacaaagcggtacagcgttcagcagatctagtgtctatcggtccaatgcttcaaggtatgcgcaagccagtaaatgacttgtcacgtggcgctctagtagacgatatcgtttacactgtagctctaacggctatccaagcagaccaagcagctcaagctgaagaaaaagtaattaactaa

SEQ ID NO: 1557 - DNA, 2172 bp, Aliivibrio salmonicida LFI1238
atgtctcgtactattatgcttgttccaatcagtgctggtgttggtctaactagcgcaagtttgggtgttttacgttctatggaacgtaaaggcgtaagcgtttctttttacaaacctatctctcaacctcgtcacggtggtgatcaacctgatctaactacgtcaattgtgactagcagcagcgatattaaagcagcagaacctacaaccgtttctcgtgcagaagaacttctacgtaacgatcaaactgatgttcttttagaagaaatcgttgctcgttataagtctatcagtgaagacactgatgtgacgcttatcgaaggtcttgttcctactcgtaagcacccatttgctaaccaattaaatggtgaaattgcaaaaactctgggcgctgagattgtatttgtagcgactcctggtacagacaacccttctcaacttaaagagcgtatcgaagtagcatgttctaacttcggcggcactaaaaacaaacaaatcgctggtgttatcatcaacaagcttaatgcgcctgttgatgaagccggtcgtactcgcccagacctatctgaaatctttgatgatgcagatgcaacgactaagactaatcttgaagtaatgcaaatcttcaactctagtcctattcgtgttcttggttgtgtgccttggaaaatcgatctaatcgctacgcgtgctatcgatatggctaagcaccttaatgctgaaatcatcaacgaaggtgaaatcgcgactcgtcgcattaagagcatcactttctgtgcacgttctctaccgcacatgattgagcacttcaaaccaggttctcttctagtaacttctgctgaccgtcctgacgttattgttgctgcatgtcttgctgcaatgaacggcgttgaaatcggtgcgatcttactaactggtggttacgaaatcccacaatcaatcgctgatctttgtaagcctgcacttgatgctggtcttccaatcttcacggctcaaggtaatacttggcagacttctctaaatctacaaagcttcagccttgaagttcctgcagatgataaagagcgtattgagtttgttaacgaacacgttgctagccacattgatggcccttggattgattcactatctgaaggtactgaaggcatccgtcgtctgagcccaccagcgttccgttaccagttaactgaatttgctcgtaaagccgctaagcgtatcgtccttcctgaaggtgatgaacctcgtacagttaaagctgcggctatctgttctgagcgtggtatcgcgacttgtgttcttcttggtaatcctgaagagatccgtcgtgttgcagcacaacaaggtgtcgaacttggcgcaggcgttgagatcatcgattctgaatctgtacgtgaaaaatacgttgctcgtttagttgagttacgtggcgcgaaaggcatgactgaagttgtggctcgtgagaaactaaaagattcggtattccttggtactatgatgcttgaagcgggtgaagttgacggtcttgtttctggtgcggttcataccacagcaaacacgattgttcctccattccaaatcatcaaaacagcccctgatgcttctatcgtatcttctatcttcttcatgcttctgcctgatcaagtacttgtatacggtgactgtgcgatcaaccctgatccaaccgctgagcaacttgctgaaatcgcaatccaatctgctgactctgcagcggcatttggtatcgaccctcgcgttgcaatgatctcttactctactggtgaatctggtaagggtgcagacgttgataaagtacgagaagcaaccaaacttgctcaagcaaaacgtcctgatttgatcatcgatggtcctcttcagtacgatgctgctatcatggaaaatgtagccgcttctaaagcgcctaattctcctgttgctggtaaagcaactgtatttgtattcccagacctaaatactggtaatacaacgtacaaagcggttcaacgttctgctgacctagtatctatcggtccaatgcttcaaggtatgcgcaagcctgtaaatgacttgtctcgtggcgctctagtagacgatatcgtttacacagtagcactaacggctatccaagcatctcaagctgaagaagcagagaaagctgaaaaagtaattaactaa

SEQ ID NO: 1558 - DNA, 2145 bp, Vibrio cholerae bv. albensis VL426
atgtcccgtactattatgcttatcccaatcagcgctggcgtcggtctgaccagcgtgagcatgggtctcctgcgcgccatggagcgtaaaggggttagcgtttctttctataagcctatcgcgcagccacgtactggcgatgatcaacctgacctgacgtctactgtcatgagccgcaacagcgacatcaagatcggccagccgatgagtatgtctgccgccgagactctgatcggtagcgagaagatggacgttctgctggaaaccgtggttgagcgttacaaccagatcaacaaagatgcagaagtgactctgatcgaaggtctggttccaacgcgtaagcacccttttgctaaccaagtgaacgcggagatcgccaacactctcggtgcagaaattgtgttcgttgccactccgggaacggataacccaacccaactgaaagagcgcattgaagtcgcgtgctctaactttggtggcaccaagaacaagagcatctctggcgttatcatcaacaagctgaatgcccccgttgatgaagctggccgtactcgtcctgacctatcagagatctttgatgatgctgaccatgcgaaacaagctaaccttgaagtgatgcagatcttcaacaccagcccaattcgtgtgctgggctgtgtgccatggagcatcgacctgattgcgactcgtgctatcgatatggcgaagcacctgaaagctgagatcatcaaccaaggtgatatcaatactcgtcgtatcaagagcatcactttctgtgctcgctctatcccgaacatgattgagcacttcaaaccaggctcactcctagtaacctcagctgatcgccctgacgtgattgtggctgcggcactcgcagcaatgaacggtgtggaaatcggtgcagtactgctgactggcggctacgacatcccacgtgaactggttagcctatgtaagcctgcttttgacacgggcctgcccattttcaaagcgcaaggtaacacttggcaaacgtcgctgaacctacaaagcttcagccttgaagttccagccgatgacaaagagcgtatcgaattcatcagcgaacacgtggcaagccacattgacggcccatgggtagactctctgactgaaggtgcgcaagcgtctcgtcgcttgagcccacccgccttccgttaccaactgactgaattggctcgtagcgcgaacaagcgtatcgtactgccagaaggtgatgagccacgtactgtgaaagcagctgctatctgtgctgagcgcggtattgcgcagtgtgtacttctgggtaacccagaagagatcaagcgtgttgctgctcagcaaggtgttgaactcggctctggtatcgaaatcatcgatccaaaagtggcacaagagaaatacgtagcacgtctggttgaactgcgtaagagcaaaggcatgactgaagtggtggcgcgcgagcaactggaagataccgctgttctcggcactatgatgcttgagcgtaacgaagttgacggtctggtttctggtgcggttcacaccacagcaaacaccattcgtccaccactacaaatcatcaagactgcgccgaatgcgtctctggtttcatcgatcttctttatgctgctgcctgatcaggtactggtatacggtgactgtgcgatcaacccagatccaaacgcagagcaactggctgagattgctatccagtctgccgactctgcagcagccttcggtattgagcctcgcgtagcgatgatctcttactcgaccggtacttctggtcaaggtgcagacgttgataaagtgcgcgaagcaactcgcatcgccaaagagaaacgtccagatctcgtgattgatggtcctttgcaatacgacgcagcaatcatggaaaacgtagcggcttctaaagcgcctaactcgccagtggcaggtaaagcgaccgtattcgtattcccagatctgaacacaggtaacacgacttacaaagcggtacaacgttcagcggatctagtgtctatcggtcctatgctgcaaggtatgcgtaagccagttaacgacctgtctcgtggcgcattggttgacgatatcgtctacaccatcgccctgacggctatccaagcgggtcaagagcagaaataa

SEQ ID NO: 1559 - DNA, 2154 bp, Aeromonas salmonicida subsp. salmonicida A449
gtggcacgcactattatgcttatcccggtcggcactggtgtcggcgtaacttccgtgagtcttggcgttgtccgcgccatggaacgtcacggtgtcaatgtcagcttcttcaaaccggtcgctcagccgcgtccgggtgaaaccggtaccgagcgttccaccgccgtgatccgcgctgctgccaacatcaacccgcccgagccattcgccctctcctacgccgagaacatgatcacctccagcaacaccgacatcctgctggaagagatagtggctcgctttgaagagcacgtgaaggccagcggtgccgaagtgctggtcatcgaaggcatggtaccgaccgacaagcagccgtttgccaacaagctgaactatgacgtcgccaaggcgctggatgccgacatggtgttcgtgacccatccgggcaacgactccagccagaagctcaaagagcgcatcgagctggcctgctccaacttcggtggcgtcaacaacccccgtatcgtgggttgcgtcatcaacaaggtaggtgctccggttgacgagcacggcgtgacccgcccggacctgaccgagatgttcgaggcgcaccaccacgcttctgaagcggcccacaatctggaagtgctgcaagtgttcggcaagagcccgctgcgtatcctgggttgcataccctggaatacccagctgatcgccccgcgcgccaaggatctcgccaaacatctggccgccaagatcctgcacaagggtgagctggacagccgtcgcctgcaaaccgtgaccttctgtgcccgctccatccacaacatggttgagcacttccgtcctggcagcctgctggtgacctccggcgaccgttccgacgtcatcgtctccgcctgcctctccgccatgaacggcgtcaagctgggcgcactgctgctgaccggcaactatcatcccgagccgcaagtgatggccctgtgccaacaggccatggccaccggcctgccgatcatgatcactggcaccaacacctggcagaccgccgtcagcctgcaaaacttcaacgtcgatattccggaagatgaccgcgagcgtatcgagctggtgcaggactatgtggctggccacatcgacaagcactggatcgagtctctctccgccaagtctacccgttcccgtcgtctgagcccgcctgcgttccgttatcagctgaccgagctggcccgtcaggccaacaagcgtgtcgtgctgccggaaggcgaagagccgcgtaccatcaaggcagcttccatctgtgccgagcgtggtatcgcccgtcctgtgctgctgggtaacccggaagagatccgtcgcgttgcagagcagcagggtgtggtgctgaccgacagtgtcgagatcatcgacccgctggaagtgcgcgagcgctatgtgccgcgtctggtcgaactgcgcaagaacaagggcatgaccgaagtggttgcccgcgaacagctggaagacaacgtggtgctgggcaccatgatgctggagcgtggcgaagtagacggtctggtatccggcgcggtacacaccaccgccaacaccatccgtccgccgatgcagatcatcaagactgccccgggctcttccctgatctcctccatcttcttcatgctgctgcctgatcaggtgctggtgtacggtgactgcgccatcaacccggatccgactgccgagcagctggccgagatcgccatccagtccgccgactccgctgccgccttcggcatcgagccgcgcgtcgccatgatctcctactctaccggtacatctggcgccggtgccgatgtagagaaagtgcgtgaagcgaccgagttggccaaggccaagcgccccgacctcatcatcgacggtccgctgcaatacgacgcggccatcatggagaacgtggccaagtccaaggcccctaactcaccggttgcaggtaaagccacagtgttcgtcttcccggatctgaacacaggcaacaccacctacaaggcggtacagcgttccgcagatctggtctccatcggccccatgctgcaaggcatgcgcaagccggtcaacgacctgtcccgtggcgccctggtagacgacatcgtctacaccatcgccctgaccggtatccaggcagctcaggccgagtaa

SEQ ID NO: 1560 - DNA, 2157 bp, Tolumonas auensis DSM 9187
gtggctcgtacaatcatgcttatcccgattggcaccggtgttggcgttacctctgtaagtctgggcatggtccgggcgatggagcgtcatggcgtcaacgtaagcttttttaaaccggtagctcaaccgagacctggccaatctggcccagaaacatcaaccgccgtcatccgtgccggttcaaacatcacacctcctgaaccgctttccctgcaatatgcagagaatatgatcacctcaaacaacagtgcagtactgctggaagagattgttgcgctttatcagcgacatattcaagagagtggtgccgaagtcgtggtgattgaaggcctggtgccagttgagaagcaaccttttgctaataaactgaatcaggacatcgctactgcactggatgctgaaatcgttctggtaacccatccgggtaattactccagccagaaactgaaagaaagcatcgaattggcctgttctaattttggtggcaccggcaacaaacgtattgttggctgcatcatcaataaagtgggtgctccggttgatgaacacggcattacccgccctgatctgaccgaaatgttcgaagctcatcatactggcgagagcggaagcaaccagctggaaattctgcaattcttcggtaaatcaccactgcagatcctgggttgcattccatggaatgcacagctgatcgcaccacgtgcgattgatctggctcgtcacctgaacgcacgaatcatcaatgaaggcgaaatttacacccgtcgtctgaacattgtgactttctgtgcccgttctattcataacatggtgcagcatttcaaaccgggcagcctgctggtaacttccggcgaccgttctgatgtgatcgtgtctgcctgtctgtctgcgatgaacggcgtcaagctgggtgcattgctgctgactggtggctatcatccggaaccacaggttatggctctgtgtcagcaggcaatgcagactggtctgccaatcctgatgatcaataccaatacctggcagacagcggtcagcctgcagaacttcaatgttgaaattccgattgatgataatgcccgtattgaactggtacaggattatgttgccggccatattgataagcattggttagaatcactgacatctgaatccagcctgccgcgtcgtctgagcccgccagcgttccgttatcagctgaccgaactggcccgtgctgcaaacaaacgtatcgtactgccagaaggtgatgagcctcgtactatcagagcggccgctatctgcgctgatcgtggtattgcccgtccggtattgctgggtaatccggatgaaatccgtcgtgttgctgaacaacagggcgtcgtgctgagtgatcgcgttgaaattatcgacccggttgaagcacgtgagcgttatgtaccgcgtctggtcgagctgcgtaagagcaaaggtatcaccgaagttgtggcccgcgaacagctggaagacaacgtagtgctgggtactctgatgctggaacgcaatgaagtggatggcctggtttccggtgctgtgcataccactgcgaataccattcgtccgccgctgcagatcatcaaaactgcgccaggcagctcattggtatcatccattttcttcatgctgctgccggatcaggttctggtttatggtgactgcgcgatcaacccggatccaaacgcagaacagctggctgagattgccattcagtctgcagattctgcagctgcatttggtatcgaacctcgtgttgcgatgatctcctactctaccggcacctcaggtaccggtgctgacgtagataaagtccgtgaagcaacccgtattgcgaaggaaaaacgtcctgatctgatcatcgatggtcctctgcagtatgacgcagccgttatggctgatgtggcccgttctaaagcaccgaattcaccggtagcaggtaaggctaccgtgttcatattcccggatctgaacactggtaacaccacctataaagcggtacagcgttctgctgatctggtctctatcggcccgatgctgcagggtatgcgtaaacctgttaatgacctgtctcgtggcgctctggttgacgatatcgtttacaccatcgctctgactggtattcaggcaactcagactcctgcctga

SEQ ID NO: 1561 - DNA, 2163 bp, Psychromonas sp. CNPT3
atgtcccgtactattatgctcattcctattggctcaggcgtaggtgttacctccgtcagtcttggaatggttcgcgctatggaacgtcaaggtatcgcagttaactttttcaagccaattgcacagcctcgccctggtgacacaggccctgaacgctctaccgcaacgctgcgtaatgcctctgttctttgcccgcctgaaccttttgcaatgaaatatgcagaaaacatgctttcatcaggacgcaaatcagatctacttgaaaatattgttgagcgtttccgtcaaggcaccaaagacaatgatgtgatcattgttgaaggtttagtaccgactgataaacatcagtttgccaatgaaattaactacagcattgctaaagcattaaacgctgaaatggtttttgtgacgcatccaagtaatgattcttcacaacagctaaaagagcgtatggaaattgccgttgatgcttttggtggtaaaaagaataaacgtattgcgggctgtattatcaataaagtcggcgcaccggttgatgaacatgataaaagtcgtccagatcttagtgaaatgtttgatatcccagaagtaaatgcgcaaacaaatcttgaagtattacaaatgttcagcaagagcccattacctattttgggttgtattccttggagcgcagatcttattgccccacgcgtacaagatttaatacaatacttagatgcacaagtgctaaataaaggtgatgctgcgcatcgacgcttacattccgttactttttgcgcacgctcaattccaaatatgctagagcactttaaagcgggctcaatgctagtgacttcaggcgatcgtagtgatgtgatcattgctgcgtgtcttgctgttatgaatggtatgaaaattggttgtttactgcttactggtgattacatgccagaagacgaagtgatgaagctttgtgaacgcgcgatggaaacaggtttacctgtattacttatcaaaagtaacacatggaaaacggcgcaacgcctacaaaacttcaacatggaaatacccgttgacgatatagagcgtattgaaaaagtacaagattatattgctagccatattgataatcattggttaagtacattgaccaatgattctactttgtcacgccgtttgtctcctcctgcgttccgttatcatttaactgagcttgcacgtcaaactagacaacgtattgtattgccagaaggtacggagcctcgcaccattcaagctgcacttatttgtgcacaacgtggcattgcaacaccggttttattaggcgatcctaaagagatccatcgcattgcttcactacagggtattgaattaacagatgatgttgaaatcattaacccacttgatgtgttcgaaaactacgttgcacctatggttgaactacgtaaagcgaaaggcttaaccgccgtcgttgcacgtgaacaattacaagataccgttgtattaggcaccatgatgttagctgaaaatgaagtggcaggtcttgtatctggcgctgtgcatacaacagcaaatactatccgcccagcactacagcttatcaaaacagcaccgggcgcaagcttagtgtcatcagtcttctttatgttactacctgatcaagttttcgtttatggtgattgtgctattaatcccgatccaacagccgatcaacttgctgatatcgctatccaatcagcagattctgccattgcttttggtattgagcctaaagttgcgatgatcagttactctacgggtgactcaggtgcgggatcagatgttgaaaaagtacgtgaagcaactaaaattgcacaacaacgtcgtccagacttattaattgatggtccacttcaatacgatgcggctgtgatggaaaatgttgcaaaaagcaaagcgcctaactctaaagttgcgggccaagcaactgtatttatcttcccagatctaaatacaggtaacacgacttataaagcagtacaacgtagtgctgacttaataagtatcggtccaatgttgcaaggtatgcgtaaacctgtgaatgatttatcacgtggcgcattagtcgatgatatcgtttatacggtcgcgttaacggctattcaagcaacacaatcacaacaacgtgatgcggctaaaaaatag

SEQ ID NO: 1562 - DNA, 2163 bp, Psychromonas ingrahamii 37
atgccccgcacaattatgctcattcccatcggttccggtgttggtgttacctctgtcagtctcggtatggtccgcgcactggaacgtcagggtgtcgcagttaacttcttcaaacctattgcgcaaccacgttctggagatgtaggtccagagcgctctacggcaacactgcgtaatgcttcagctttgaatccgcctgaaccctttgcaatgaaatacgcagaaaacctgatttcctccagcagaacgtcagagttattagaaaatattgttgaacgttttcgtcaaggcaccaaagaaagtgatgtgattattgttgaagggcttgtgccaacggataagcatcagtttgccaacgaaatcaactacagtattgccaaagcattaggtgctgagatggtctttgttactcatccgaataatgacacttcacagcaattaaaagagcgcattgaaattgctgtctcttcttttggtggtaaaaacaatcaacgtattgccggttgcattatcaataaagttggcgcaccaagcgatgaaagtgaacagtaccgtccagatttaacggaaatgtttgagggtgctcacgactcgttaaacagtaatcttgaagtattgcaaatgttcagtaaaagtccattgcccattttaggctgtattccttggagctcagaactgattgcaccacgcgttgtcgatcttgctacccatttacatgcgaaaatattaaacaaaggtgacctaaacacccggcgtttacaacgggtcacattctgtgctcgctcgatcccaaatatgcttgaacatttcaaagccggatccatgctggtcacatctggtgaccgcagtgatgtgattatcgccgcctgtcttgcggtaatgaatgggatgaaaattggttgtttattactgaccggtgattacacacccgaagccgaggttatgaagttatgtgcacgggcaatggaatccggtttaccgattctcctaatcaatagcaacacatggcaaacggctcagcgcctgcaaaacttcaatatggaaattccagttgacgatatagagcgcatagaaaaggtacaagaatacattgccggccatgttgataagcactggttaaaaacattaaccggggattcatctttatctcgccgtttatcaccaccggcattccgttatcatttaacggaacttgcacgtaaaaacagccagcgtattgtgctgcctgaaggtgaagagccgcgtactattcaagctgcccttatctgtgcacaacgtggtattgcaaaacctgttctattaggtaacccggaagagattcaccgtgtcgcaacacagcagggcattgttttaaccgatgatgttgaaatcatcaatccagacgatgttattgaagattatgttgcccctatggtggagctgcgcaaatcaaaaggcctgacggaagttgttgcccgtgaacaattacgagatacagttgttttagggacaatgatgctggctgagggtgaggtatccgggcttgtctcaggtgcgcttaacaccaccgcaaataccattcgacccgcactgcaactgattaaaacagcgcccggcgcaaacttagtttcttctatcttctttatgcttctacccgatcaagtattagtctatggtgactgtgcaatcaatccggatccaagcgcagaacaacttgctgatatcgcaattcaatcagcggattcagctatcgcattcggtattgaccctaaagttgccatgatcagttattcaacgggtacgtccggtgtcggctctgatgttgataaagtgcgtgaagcaactaaaattgcgcaacaacgtcgtccagatttgctgattgatggtccgcttcaatatgatgcggcggtaatggaaaatgtagcaaaaagtaaagcgccggacagtccggttgccggtaaagcgactgtctttatcttcccggatttgaataccggtaatactacttataaagcagtacaacgtagtgcaaatttaatcagtattggtccaatgctgcagggtatgcgtaaacctgtcaatgatttatcacgtggcgcattagttgatgatattgtttacactatcgcgttaacggccattcaggcaacgcaagccatggataaagcaatcgctaacgtttaa

SEQ ID NO: 1563 - DNA, 2142 bp, Shewanella sediminis HAW-EB3
atgtctcgcaacattatgttaattcctatcggcacgggtgtcggtctaacttctatcagtttgggactcgttcgtgcttttgaacatcacggcgttaaagttcgttttttcaagcctattgcacagcaacgtccacatgatactgggccagagcgctcaaccacgatcttaagtaagtcacccacagttaacccacttgaaccatttgagatggcgcatgcggaaagcttaattcgtggcgatcaaactgataccctgatggagcagatcattgctcgtgtcaccgaatatgcagatgaaagcgagacgcttgtcgtagagggactggttcaaaccagaaaccacccattctcgagcgagataaactacgccattgccaaggcactcgatgcggatatcatttttgtcgcaacacctggtaatgaaagtgcaacagcactaatgaaccgtcttgaaattgctcataattcatggggcggaagcaagaacaaacgtattattggcgcgattgtaaataagattggtgcaccggtagataacgaaggtcgcgcacgtccggatctatctgaagtatttgaccatgcagatatacagcgtccagatgcagcgagtatgttccaacttccaggaaagagctcacttcgtatcttaggtagcgtgccatataatttagatcttgttgcaccacgtgcatccgatctggctaagcacttgagtgctaaactcatcaacgccggcgaaatgaacacgcgtcgcctgcgtaaagtgactttctgtgcccgaagcattccaaatatggtcactcatattaagactgattcactgctcgtgacctctggcgaccgttccgatgtcatcgtatcagcctgtcttgccgccatgaacggcgttaaggttggcgcactattgctgacgggtagttatgagccagagcctgagatcatggctctgtgtgaacaagccttcgaaacgggtctgcctgtattcttaatcgataccaacacatggcaaacgtcgcttaatatccaacgtttcgaccatgaagtaccagtcgatgatgccgtacgtatcgaagaggttcaggagtacgttgccagccatattgaccaaaactggattgctacggtcactaagaactcacctcgtgaacaccgtttatcaccaccagcattcagatacaaactgactgaattggcacgtgaagcccgtaaaacggttgtattacctgaaggtgccgatccacgtaccatcgaagcggccagtatctgttccgatcgtggtatcgctaagtgtgtgttacttggtaatcgcgaagagattgagcgcattgccgtacgccaaggcgttgtgttgggtgaaggcgttgagatcatcgacccattatcggcgcgcgaacgttatgtcgagccaatgcttgaactgcgtcgccataaagggctgactgaagtcgttgcacgtgagcagctggaagacaacatggtgctgggcactatgatgctggcgcaaagtgaagtcgatggcattgtatcgggtgcggttaacactacagctcatactattcgccctccactgcaattaattaaaacggcaccgggctcaagcttagtctcatcaatcttctttatgttgatgccagatcaagtgcttgtttatggtgattgtgcgattaacccggatccaaacgctgaacagttggcagacatcgctattcaatcagccgagtctgctgcagccttcggtatcgagccaagagttgcgatgatcagctactctaccggtagttcgggtacgggatcggatgttgataaggtacgtgaagcgactcgtatagccaaagagaagcgtccggatcttattatcgatggaccgctacaatatgacgcagcagtcatgccaaacgtggctcagtctaaagcgcctaacagccctgtagcgggtcaagcaacggtatttgtattcccagacttgaatacgggtaatacgacgtacaaagcggttcaacgaagcgctgaccttataagtattggcccaatgcttcaaggtatgcgtaaaccggtcaatgacctctctcgtggtgccctggtcgatgatattgtctataccatcgcactcacagccattcaggcatctcaacagaaataa

SEQ ID NO: 1564 - DNA, 2142 bp, Shewanella woodyi ATCC 51908
atgtctcgcaatattatgctaatccctatcggcacaggtgtcggtctcacatccatcagtttaggactcgttcgagcttttgagcatcacggtgttaaagttcgctttttcaaaccgattgcccagcagcgtccacaagacagcggacccgagcgttcaacgactatcttaagtaagtcgccaactgttaacccgcttgagcctttcgatatggatcatgcagagggacttattcgtggcgataagactgacgtcttgatggagcagatcattgctcgcgtaacggagagcactgacgacactgaaactctcgtggttgaaggcttagttcaaacaagaaaccacccgttctcaagcgatatcaactatgctatcgcaaaatctctcgatgctgacatcatctttgttgccacgccaggtaatgaaagtgctacagccttgatgaaccgtttagagatcgcccataacaaatggggcggtgttaagaacaagcgtattatcggcgccatgatcaataaaattggtgcacctgttgataacgaaggtcgtgcacgtcctgatctatctgaagtgttcgaccatgcagatgttcagcgccctgacgctgccagcatgttccaacttccaggtaagagttcactgcgtattttaggtagtgtgccttataacttagaccttgttgcacctcgcgcatcggatcttgctaagcacttaagtgcaaagatcattaatgctggtgagatgaacactcgtcgtctacgtaaagtgaccttctgtgctcgtagtattcctaacatggttactcacattaagactgactcactgttagttacctcaggcgatcgctctgatgtgatcgtatcagcctgtcttgcagcgatgaacggcgtaaaagtcggtgcactactgctaaccggtagttatgagccagagccagagatcatggcattgtgtgagcaagcattcgaaaccggtctaccagtattcctaatcgatacgaatacttggcagacatcgctaaacattcaacgtttcgaccatgaagtccctgttgatgacgcagtgcgcatcgaagaggttcaagagtatgttgctagccatatcgaccaaaactggattgaaacggcaactaaaaactctcctcgtgagcacagactctctcctcctgcatttagatacaaactgactgagcttgcccgtgctgcccgtaaaacagttgtactgcctgaaggtcatgactcacgtactatcgaagctgcaagcatctgtgctgaacgtggcatcgccaagtgtgtacttcttggtaatcgtgaagagatcgaacgtatcgctgcacaacaaggtgtcactttaggtgaaggcgttgagattgttgagcctgatactgcacgtgagcgttatatcgagcctatgcttgatctacgtcgtcacaaaggcctaactgaagtcgtagcccgtgaacaactcggtgacaacatggtactagggaccatgatgctagctcaaaatgaagtcgacggtattgtctctggtgcggtaaacaccacagctaacaccattcgcccaccattacagttgattaaaacggccccaggttcaagtttagtctcgtcaatcttctttatgttgatgccagatcaagtactgatctacggtgactgtgcaattaaccctgatccaaatgccgatcaacttgccgatatcgctatccagtccgcagattcagccgcggcatttggtatcgagccacgggttgcaatgatcagttactctaccggtagttcaggtactggctctgatgttgataaggtacgtgaagcaacgcgtatcgctaaagagaagcgtccagatctgatcatcgatggtccattgcagtatgatgctgcggttatgccaaatgttgctcaatctaaagcccctaacagtcctgtagctggtcaagcaacggtatttgtattcccagacctaaatactggtaatacgacatacaaagcagtacagagaagtgcagacctaatcagtattggcccaatgcttcaaggtatgcgtaagccagttaacgacctatcacgtggcgcattggttgacgatatcgtttacaccatcgcattaacggcaattcaggcttcacaagctgagtaa

SEQ ID NO: 1565 - DNA, 2139 bp, Shewanella loihica PV-4
atgtctcgcaatattatgctcatccccaatggtaccggcgtcggcctgacttctatcagtctaggcatggtacgcgcgctggagcgccacggggtaaaggtgagattcttcaagcctatcgcccagcagcgcccaaccgataagggccctgagcgttcgaccaccatcctaagcaagtcgccgacggttaacccgctcgagcctttcgacatggctcacgccgagcacttgatccgcaccgatcagacagatgtcctgatggagcagatcatcgcccgcgccaccgagtgtgccgacccaagcgaaaccctgatcgtcgaaggtctggtacaaacccgcaaccaccctttctctgacgacatcaactacgagatcgccaaggcgctggatgctgacatcatcttcgtcgccgcgccgggtaacgaaaccccgaccgccttgatgaaccgtctcgaaatcgcccacaacgcctggggtggcagcaagaacaaacgtctcatcggcgccatcatcaacaagattggtgccccggtagacgatgaaggccgcgcccgcccggatctgtcagaggtgttcgatcaccaggatgtgcagcgtccagacgccgctagcatgttccagcttcccggtaagagtaagctgcgtatcctaggcagcgtgccatataacttgaatctggtcgcaccacgcgcctcagatttggccaagcacttgagtgcccgcatcatcaacgccggcgagatgaatacccgtcgtctgcgcaaggtcaccttctgcgcccgcagtattcctaacatggttacccacatcaagacagactctctgctggtgacctcgggcgaccgctcagacgttatcgtctctgcctgtctggcggcgatgaacggcgtcaaggtgggtgcactgctgctgacaggtagctacgagccagagcctgagatcatggccctgtgtgagcaagccttcgagacaggtttgccggtattcttgatcgacaccaacacctggcagacctcgctcaatatccagcgcttcgaccatgaggtgcctgtggatgatgccgtgcgtatcgaagaggtgcaggaatacgttgccagccatatcgaccagagctgggtagaaagcgtcaccatgaactcaccgcgtgagcacagactgtcgccacctgcgttccgctataagctcaccgagcttgcccgcgccgcggccaagacagtggtactgcctgagggtgacgaaccaagaaccatcgaagcggccgccatctgcgccgaacgtggcattgcccgctgtgtgctgattggaaaccctgaagagatccagcgtatcgccagccaacagggtgtaaccctgggcgaaggcgttgaaatcatcgagcctgaaaccgctcgtgagcgctatgttgcgcctatggttgaactgcgtcgacacaaaggcatgacagaagtggtcgcccgtgagcagctggaagataacatggtactgggtaccatgatgctggcacagggtgaagtcgacggtatcgtctctggtgcagtaaacaccacggccaacaccatacgtccgccactacagctgatcaagacggcgccgggttctagcttggtttcctctatcttcttcatgctgatgccggatcaggtactggtttatggtgactgtgccatcaacccagatccaaacgccgagcagctggcggatatcgccattcagtcggcagatagcgccgcggccttcggcatcgagcctaaggtagccatgatcagctactcaaccggtagctcaggcacaggttcagacgttgataaggtacgcgaagcaacccgtatcgccaaggagaaacgccctgagctggtgatcgacggcccattgcaatatgacgccgccgtgatgccaaacgtagctcaatctaaggcgccaaacagcccagtggccggtcaggcaaccgtgttcgtcttcccggatctgaacacaggtaacaccacctacaaggcggttcagcgtagtgcggatctgatcagtatcggccctatgctacaaggtatgcgcaagccggttaacgatctgtctcgtggcgccctggtagacgacatcgtctacaccatcgcactgacggcgattcaagcctcacagaactaa

SEQ ID NO: 1566 - DNA, 2148 bp, Shewanella halifaxensis HAW-EB4
atgtctcgtaacattatgctcattcctgtgggtaccggagttggtttaacatccatcagtttaggtatggtacgtgcacttgaacgccacggcgttaaagttcgctttttcaagcctatcgctcagcaacgtccaaatgacaacggcccagagcgttcaacaacgattttgagcaagtctcctaccgttaatccactcgagccattcgagatggagcacgctgagaagcttattcgtgcagaccaaactgatgtgttgatggagcagatcattgctcgtgcaacagaatgtgctgatgatacagaaacgttgatcgtcgaaggcttagtccagactcgtaatcatcctttctcaagcgatgtaaaccatgctatcgcaaaggcacttgatgctgacattatttttgttgccactccaggtaacgaaagtgctacagcattgatgaaccgcctagagatttctcataactcttggggtggatctgaaaacaaacgtttaattggtgcaatcgtcaacaagattggcgcaccggttgatgacgaaggtcgtgcacgtccagatctatcagaagtatttgatcatgatgaaatgcaacgtccagatgctgcaagcatgttccaacttcctggcaagagcccacttcgtattttaggtagcgtgccttacaacttagatttggttgcaccacgtgcgtcagatcttgctaagcacttaagcgctaaaatcatcaacgccggtgagatgaacactcgccgtatgcgtaaagtgactttctgtgctcgcagtattccgaatatggttacccatattaaaactgattcactacttgtgacttcaggcgatcgctctgatgttatcgtttcggcctgtcttgcatcaatgaacggcgtaaaagtcggtgccttgctacttactggtggttatgagccagagccacagatcatggagctttgtgagcaagcattcgaaacgggtctacctgttttcttaatcgatactaacacttggcagactgcgctaaacatccagcgttttgaccatgaagtgcctgttgatgacgctgtacgtattgaactcgttcaagagtttgttgctagccacatcgatcagaactgggttgaaagcatcactaaaaactcacctcgtgaacaccgtttatcaccacctgcattccgttacaagctaactgaacttgctcgtgcggcgcgtaagactgttgtattacctgaaggtgacgagccaagaaccatcgaagccgctgccatctgtgctgaacgtggcattgcacgttgcgtactattaggtaaccgcgaagagattgagcgtatcgcaacacaacaaggtgtagtgctaggcgatggcgttgaaattatcgacccagaaacatcacgtagccgttatgttgaggcgatggttgaactacgtcgcggtaaaggtctaactgaagttgttgccagagagcaacttgaagacaacatggtactaggtactatgatgctagctcaaggcgaagttgacggtatcgtatcgggtgcggtaaacaccactgcgaatacaattcgtccaccactacagttgattaagactgcaccaggttcaaacttagtgtcttctatcttcttcatgctaatgcctgatcaagtttatatctacggtgactgtgcgattaatccagatccaaatgctgagcagctagccgatatcgcgattcaatctgcagaatctgcaattgcattcggtatcgagccacgcgtagcgatgatcagttactcgactggtagttcaggtacaggttctgacgtagataaggttcgtgaagctacacgcatcgcgaaagagaagcgtccagatcttatcatcgacggtcctcttcagtatgacgcagcggtaatgccaaacgttgctcgctcaaaagcgcctgacagcccagttgctggtcaagcgactgtattcgtattcccagatctaaacacgggtaacacgacatacaaagcggtacagcgtagtgctgacttgatctctattggcccaatgcttcaaggtatgcgtaagccagtaaacgatctatctcgtggtgcattagttgacgatatcgtttacacgatcgcactaactgcaatccaagcggcacagaacgaaaaagcttaa

SEQ ID NO: 1567 - DNA, 2154 bp, Shewanella sp. ANA-3
atgtctcgaaatatcatgttaatccccataggcactggagttggcctgacctccttaagcctaggtatggtgcgcgcgttagagcgccacggggtaaaagtccaattctttaaacccatttcccagctgcgtcctaatgataatggcccagagcgctcaaccacgattttaagcaaatcgcccacggtcaatccgttagagcccttcgacatggcccatgccgaagcactgatccgtgccgatcaaaccgatgtgctaatggagcaaatcattgcccgcgccgcagaatgcgccagcaataccgaaaccctgattgttgaaggcctagtgccaacccgtaaccatccctttgccgacgatgtgaactacgccatcgccaaggcaatggatgcggacgtgattttcattgccacccccggcagcgacaccccaaccggcctgatgaaccgcctcgaaattgcctacaactcgtggggcggcaaaaacaacaaacgtcttattggtgccgtgatcaacaagattggcgcaccggtagacgatgaaggtcgcgctcgcccagacttatcggaagtgttcgatcatcaaggcgtacaacgctcagatgcgtccatcatgttccaaatgccaggtaagagcccactgcgcatcttaggtagcgtgccttacaacctcgatttggttgcgccacgcgcatcggatctggcgaagcatttacgtgcccgcattctcaatgccggcgagatgaacacccgccgtctgcgtaaagtcaccttctgcgcccgcagcttgcccaatatggtcaaccacattaagacagactcactgctggtgacctctggcgatcgctccgatgtgattgtgtcagcgtgtctcgccgccatgaacggcgtgaagattggtgccctactgctcactggtagctacgagccagagcctgaaattctgaaactgtgtgaacaggccttcgagacaggtttaccggtattcctcatcgatactaacacttggcagacgtcattaaatatccaacgcttcgaccacgaagtgccagtggatgatgcggtacgtatcgatttagtccaagagtacgttgccagccatatcgatcagagctggattgaaagcgtgaccaaaaactctccaagggaacatcgtttatcacctcccgcgttccgttataagctcaccgaacttgcgcgcgccgcccacaaaactgtggtactgcctgagggtgatgagccacgtaccatcaaggccgccgcgatatgtgccgaacggggtattgcgcgttgcgtgctgttaggtaaaaaagatgaaattcaacgtattgcagcacagcaagacgttgttctgggcgaaggcgttgtgattgtcgaccccgatgaagttcgcgatcgctatgttgaaccaatgctcgatctgcgtcgcaacaaaggtttgactgaagtcgttgccaaagaacaattagaagacaacatggtgctcggcactatgatgctggcgcaaaacgaagtcgatggtatcgtctctggcgcggtaaacactacggccaatacgattcgtccgccgctgcaactgatcaaaaccgcaccgggttctagccttgtttcttccatcttctttatgttgatgccagaccaagtgctggtttacggtgactgtgcgattaaccccgatcctaacgctgaacaactggccgatatcgcgattcaatcggcagaatctgccaaggccttcggcatagaaccaagagtggcgatgatcagctactcaaccggtaactcaggtactggttcagatgtggataaagtgcgtgaagcgacccgtatcgcgaaagaaaaacgtcctgatctagtaatcgacggtccactgcaatacgatgcggccgtcatgccaaacgtggctcgctctaaggcgcctaacagccctgttgcaggtcaagcgactgtattcgtgttcccagatctcaacacgggtaacaccacttacaaagctgtacagcgtagtgctgacctcatcagtattggccccatgctgcaaggcatgcgtaagcctgtgaacgacttatcccgcggcgccttagtggacgatatcgtctacactatcgcactgacggcgattcaagcgtcacaaaacgatgccagcaaagcctaa

SEQ ID NO: 1568 - DNA, 2139 bp, Shewanella amazonensis SB2B
atgtcccgcaacatcatgttggttcccattggtacaggcgttggcctcacctctctgagcctgggtatggtgcgcgcactggaacgccatggcgtaaaagtgcagtttttcaagcccatcagccagcagcgccctgccgattcaggccctgaacgctcaaccactatcctgtccaagtcgcccacggtgaacccgttggagccctttgacatgcagcacgccgagtcgcttatccgtaccgaccagaccgatgtgctgatggagcaaatcattgcccgcgccagcgaaattgcagccaacaccgagacgcttatcatcgaaggtttggtgccaacccgcagccactccttctccgatgacgtgaactacgctatcgccaaggcattggatgcggacgtgattttcattgccaccccgggtaacgacaccccgaacgcgctgatgaaccgtttggaaattgcctacaacagctggggcggcgccaagaacaaacgcctgattggcgccgtgatcaacaagattggtgcacctgtggatgacgaaggccgcacccgacctgacttgtctgaagtgttcgaccatcaggacatccagaaaggtgatgccacggccatgttccagctgccaggcaagagcaagctgcgtattctgggcagtgtgccttacaatctggatctggtgtctccccgcgcatcagaccttgccaagcacttgcatgcacgcatcctcaatgccggtgaaatgaacacccgtcgcctgcgtaaagtgaccttctgtgcccgctccattcccaacatgctgagtcacttccgtaccgactcgctgctggtgacctcgggcgaccgctccgatgtgattgtggcagcctgccttgcggcgatgaatggcgtgaagattggcgcgctgctgcttaccggctcctacgagccagagccggaagtactgaagctgtgcgaacaggcattcgagaccggtctgccggtgtttatgatagacaccaacacctggcaaacctcactcaatattcagcgctttaaccacgaagtgcccgtggacgatgcagtgcgaattgagctggtgcaggaatatgtggcaagccacatcgaccagagctggattgaaagcgtgaccgaaaactcgccacgcgaacaccgcctgtcgccaccggccttccgctacaagcttactgagctggcccgcgccgccaaaaagtgcatcgtactgcctgaaggcgacgagccacgcaccatcaaggccgccagcatctgtgccgagcgcggcatcgcccgctgtgtactgctgggtaagaaagacgatattttacgtattgccgcagcacaggatgtggtgctcggtgaaggtgtggaaattctcgacccagaggatattcgcgagcaatatgttgagcccatgctcaacctgcgtcgccacaaaggacttaccgaagtggttgcccgtgagcaactggaagacaacatggtactggcgaccatgatgctggccgaagatgaagtggacggcatagtatcaggcgcggtaaacaccaccgccaataccattcgtccaccgctgcagctgattaaaaccgcccccggctcaagcctggtatcctcaatcttctttatgctgatgccggatcaggtgctggtatacggtgactgcgccattaacccggatccgaacgccgagcaactggccgatatcgccattcagtcggcagagtctgccaaggccttcggcattgagccccgtgtcgccatgataagctactcaaccggtaactcgggcacgggctccgatgtggacaaggttcgcgaagctactcgcattgccaaagagaaacgccccgatctggttatcgatggcccgctgcagtatgacgcggccgtgatgccaaacgtggcccggtccaaggcacccgacagccctgtggccggtaaggctaccgtgtttgtgttccccgatctcaacacgggtaacaccacctataaagccgtacagcgaagcgctgagcttatcagtattggccctatgctgcagggcatgagaaagccggtgaacgacctgtcccgcggcgccttggtagacgatatcgtctacaccatcgccctgaccgctattcaggcgacgcagcagtag

SEQ ID NO: 1569 - DNA, 2148 bp, Shewanella frigidimarina NCIMB 400
atgtctcgtaatattatgcttattccaatcggtattggagtgggattaacatcactaagcttaggtatggttcgtgcgcttgaacgcaaaggcgttaaagtccaattttttaaacctattgctcaaattcgatctggtgatactggtccagaacgttcaaccactattttaagtacttctccaaccgtcaatccgttggaaccttattcaatggtccatgctgaagcgttaatccgttcagagcaaactgatgtcctactggaacagattattgcccgcgcagcagaatgcgccagtaatactgaaatcctagtggttgaaggcttagtaccaacacgtagccatccatttgctgatgacattaactatgaaattgccaaagcattagacgccgatgttattttcatcgcaacccctggtaacgatacgcctaatggattaatgaatcgattagaaatcgcctttaactcttggggtggacagaaaaacaaacgtttaattggcgctatcatcaataaaattggtgctccagttgacaatgaaggtcgcactcgtcctgatttatctgaagtatttgatgataaaaatatgaatgccgttgatagctcgggaatgttccaacttccgggtaaaagtccgctgcgtatattaggtagtgtgccatacaatttagagctaattgccccgcgtgcatctgatttggccaagcacttaaatgccaaaatcattaatgccggtgaaatgcatactcgtcgtatgcgccgtgtaacattttgtgctcgtagcctgcctaacatggttactcacatcaaaacaaattcattgttagtaacttctggcgatcgctccgacgtgatagtgtctgcatgtttagcagcgatgaacggcgttaaaattggcgcgttgttgcttactgggggctacccgcctgaaccagaaataatgaaattatgtgaacaagcttttgaaacaggcttgccagtatttttaattgattcaaatacatggcagacctcgctcaatattcaacgctttgatcatgaagtgcctgtggatgatgcggtgcgcgttgaaaaagtgcaagaatacgtggccagtcatattgaccaaacctggattgaaagtgttacccaggattctccacgtgaacaccgtctatctcctccggcattccgttacaagttaaccgagctagcccgtgctgcccgtaaaactatcgtgcttcctgaaggtgaagagccaagaaccgtaaaagcagcatctatctgtgctgaacggggtattgctcgttgcgtgttaatcggtaatcgcgaagagattttacgcgttgcatcgcaacaagatgttattttaggtgaaggcatcgaaatcattgagccagaaagcgtgcgtgaaaagtacgttgagcctatgctcgaattacgtcgtagcaaagggttaacagaagttgttgcccgtgagcaacttgaagacaacatggtacttggtaccatgatgctggcacaagatgaagtagatggaattgtatccggtgctattcataccacggcacatactattcgcccaccattgcagttgatcaaaacggcaccgggttctagcttagtgtcgtcgattttcttcatgctgatgcctgatcaagtcctagtgtatggcgattgcgcgattaacccagatccaaatcctgagcagctagccgatattgcgattcagtcagctgaatcagctaaagcctttggtattgagcctcgcgttgcgatgatcagttactcaacgggtacttctggcaccggttctgatgttgataaagtacgtgaagccacacgaatcgcgaaagaaaaacgtccggacttgattatcgatggtccattgcaatacgatgcagcagtcatgcctaacgtagcgctctctaaagcacctgacagccctgtcgcaggtaaagcaaccgtatttgtgttcccagatttaaacacgggtaacaccacatacaaggcggtacagcgtagtgctgatttaatcagcatcggtccaatgcttcaaggtatgcgtaaaccggttaacgatttatcacgcggcgcattagtcgatgatattgtctacaccattgcgttaacggccattcaagctgctcaaaatagtgccaaataa

SEQ ID NO: 1570 - DNA, 2181 bp, Shewanella denitrificans OS217
atgtcacgtaatattatgctgatcccaacaggcacaggagtgggtttaacctccttaagcttaggtatggttcgcgccttggaacgtaaaggggttaaggtacagttctttaagcccatagcccaaatacgcactggcgataaaggtcccgaacgctcaaccaccattttgagccaatccccctcggtgaatccccttgaacctttctccatgcatcatgctgaaaatttaattcgcgccgagcaaaccgatgtattgatggagcaaattattgcaagggccgcagagtgtgccagtaacacggaaatcatagtcattgaagggctagtgccgacgcgctcacaccctttttctgatgatattaactatgaaattgccaaagccctggatgccgatgtggtgtttatcgcaaccccaggcaatgatacggccaacggcctaatgaatcgcttggagattgcctataactcatgggggggtaataagaataagcgcttaattggcgccatcatcaacaagataggggcgccagtagatgaagaaggccgtgccagacccgatttatcagaagtctttgatcatcaaggagtgaagcattccgatacagccggtatgtttcagctaccaggtaagagcccactgcgtattttaggtagcgtgccatacaacctagatctggtgtcgccacgggcctcagatctggctaagcatttaaatgcccgcatcatcaatgccggtgaaatggacacacgccgtatgcgtaaagtcaccttctgtgcccgaagtatccccaatatggtgactcacattaaaaccaactccttactggtgacctctggggatcgctccgatgtgatagtgtctgcctgccttgcagctatgaatggtgtcaaagtcggtgctttattgctcactggaggctatcagcccgagcccgaaatcatgaagttatgcgagcaagcctttgaaactggcctgccagtgtttcttatcgataccaacacttggcaaacttcattaaacattcagcgttttgatcatgaagtcccagtggatgacgccgttcgcatcgagaaagtgcaggagtttgtcgccagccacatagatcaaaattggatagaaagtgtcacccaagattcgcctcgtgagcacagactgtcaccgccagccttccgctacaagctgacagaacttgccagagccgcgaaaaagaccatagtactgcctgaaggtgaagaacctagaaccatcaaggccgcctctatttgcgccgaacgcggcattgccaaatgtgtgctcttgggtaacaaagaagaaattgagcgtttagcctcattgcaggatttaatcttaggtgatgggatagagataatcgatcccataaacgttcgagataactacgtggcacctatgctgcaactgcgtaaaggcaaagggctaactgaggtggtcgccaaggagcaattagaagacaatatggtgctcggcaccatgatgctagcgcaagatgaagttgacggtatcgtctctggcgccatcaataccactgcaaacactattcgcccaccactgcagttaattaaaacggcgccaggttcgagcttagtgtcttccatcttctttatgttgatgccagatcaagttttggtttacggtgattgtgccattaatcccgatcccaatgccgagcaacttgccgatatcgccatacaatcggcagaatccgccaaagccttcggtattgagcctagagttgccatgataagttattcaacgggtaattcaggcacaggctcagatgtggataaagtccgtgaagccacccggattgcaaaagagaaacgcccagatttaattatcgatggcccactgcaatatgatgccgccgtgatgccaaatgtggcgcggtctaaagcaccagacagccccgtagcaggtaaagccacggtatttgtattcccagacttgaatacaggcaataccacctataaagcggtgcaacgtagtgcagatttaattagcataggccctatgcttcagggcatgcgaaaacctgtgaatgacttatcacggggcgcattagtggatgacattgtctacactatcgccttaacagccattcaagcggcgcaaaatgaagctaaattagtcttggacgtcaagccattatctaaaaattaa

SEQ ID NO: 1571 - DNA, 2139 bp, Shewanella sediminis HAW-EB3
atgtctcgtaatatcatactcatccccattggaaccagcgtaggcctgacctctgtcagcctgggcttagttcgcgcatttgaacatcatggggtaaaaattcgtttcttcaaacccattgcccaacaaagatcccacgacaagggatccgaacgttccacgacaattctgagtcaatctccaacggttaacccactcgagcccttctctatgaagtacgccgaagacatgatccgtaccaacaaaacagataccctgatggaacagattattgcccgcgtcactgaacatatcgagacatcggacactctaatcgttgagggactggtacaaacaagaaaccacccattttcaggtgatataaattacgctatcgcaaaggccctagatgcagatatcatctttgtcgccaccccaggcaatgagacaacgacagccttaatgcatcgccttgagatagcgcataacacctggggcggtgccaaaaacaagcgcctcattggcgcaattattaataaagtaggggcaccaatcgatgatgaagggcatatccaagctgatatgtcagaggtgttaaacaatagacggtcacaaggtctaaatacagcgagcatgtttaaacctattggtaaaagtccggttcgggtcctgggaattgttccctacaatttaaatctggtagcaccgagggcatcagatctagccaaacacctaaatgcaaaaattatcaacgccggagagatgagcacccgtcgcctccgcaaggtcaccttctgtgccagaagtattccgaacatggtctcacacctacaaaccgattcactactggtcacctcgggagatagatccgacgctatcgtcgcagcctgtttagccacaatgaacggagttaacattggcgccctgttactgacaggtaattatgatcccgaacctgaagtgatgactctatgtgagcaagccttagagaccggtcttccggttttcctcgccaataccaatacttggcagacctcactgaatattcagcgcttcaactatgaagttcctgtcgatgacgcagtacgtatcgaagagtgtcaggagtatgtcgcgagtcatatcgatccaagctggattaaaagcgtgacggaaaactcaccacgtgaacatcatctttcacctccggcattcagatacaagttaaccgaactggccaaagcagcctgtaaaaccgtggtgttacccgaaggtaatgagccccgaacaatcgaggctgcaagtatctgtgcccagcgcggcatcgcaaaatgtgttctactgggtaataccgaagagatcgaacgtattgccaaacagcaaggggtgactctgggagaaggggtcactattattgagccggaaacggcccgagcacgctacatcgaacctatgcttgaacttcgtagccataaagggctaaccgaggtggtcgcaaaggagcaactcgaagataacatggtccttggtaccatgatggtcgctcaaaaccaggtcgatggcatcgtctccggtgcggttaacactacggctaataccatactacctccacttcaactgatcaaaacagccccgggagccagcctggtatcatctattttctttatgttgatgccagatcaggtgctgatctacggtgactgtgcgattaacccagatcccaatgccgagcaactcgctgatatcgccattcaatctgccgaatcggccgccgcattcggcatagaaccgagagtagctatgatcagttactcgacaggtagttcaggaagtggttccgatgtcgacaaggtgcgtgaagcgacccgtatcgctaaagagaaacgaccggatctcatcatagatggtccgcttcaatatgacgccgccgttatgccaaatgtggcacaatctaaggctcccaatagccctgtagcgggtcaggcgacggtattcgtattcccagacctgaacaccggcaataccacctataaggcggtacaaagaagtgctgaactcatcagtattgggcctatgctacagggaatgagaaaacccgttaatgacctgtcacggggagccttggttgatgacattgtctacaccattgccctaacggcaattcaggcttctcaaggttaa

SEQ ID NO: 1572 - DNA, 2151 bp, Shewanella halifaxensis HAW-EB4
atgccacgtaaaataatgttggttccaatcgggagtggtgtcggtcttacctctataagtttaggtatggtgcgggcatttgaacatcaaggtgtgaaagttcgcttttttaagcctatttcgcaaattcgagtgggtgataaaggccctgaacgctctagtaccattttaggaaactctcctcgagtcaatcctattgagccttttgagatggcgtgggcgcaacagcttattcgtgaaggtaaaagtgatgtattgatggagcagattattgcaagagtcgctaaaagtattgattcaacagagactctaataatcgaagggcttgttcaaactcgcagccaaccttttgctaatgatgtgaattacgcaatagccaaagcgcttgatgtcgatgtgatttttattacttcgccgggtaatgaacaacccgatgatgttaaaaatcgaatagaaatagtctgcaaccgttgggggggggcaaaaaaccaacgaattgcgggggttattgttaatcgtatcggggcgcctgttgacgatgagggaagaattcgactcgatctttctgaggtgtttgacagtaatggcaagcttgtattcgacaataagaagttaatgcgcagtttgagtactgcttctgtgcctgttttgggggctattccttataatccagatcttgttgctcctcgagcattagatttagcaaagcacttaaatgctaaaattattaattctggtgaaatggaattaagacgcctacgccatgtgacattatgtgctagaaccataccgaacatggtttcccatttcaaaactgatgcgttactggtgacatccggtgatcgcagtgacgtgattaccgctgcctgtttagcggcaatgaatggggttaaaattggtgcattattattaacaggaggcgtggatcctgccccagaaatactcgaactttgtgctcaggctttggctacaggtatgccgatttttttggtgaatagcaatacttggcaaacggcgcttaatattcagcgctttaatcatgaagttcccgtagatgatattgttcgcattgaagagggaaaagaatttgttgctaaactcatagataaacaatgggttaaaagtgtaactaaagattcatcacgtgagcaccgtctatcacctccagcttttagattccaacttacagaaatggcacgtgctgcaggtaaaacggtggtcttgcctgaaggtaatgagccaagaacgattgaagctgcgactatatgcgctcaacgaggcattgctaagtgtatattactgggtgataaagaagagatcacccgtatcgctgcacaaaagggactgacacttggtgatggcgtggtgatcgttgaacctcatgctgttcgagaacagtatatcgagccaatgctggccttgagacgccataaagggttaaccgaagtggtggcaaaagagcaacttaaggacaatatggtgctaggcaccatgatggttgcccaaggagaagtcgacggtatcgtctctggtgccgtaaatactacggctaatacgattcggcctccactgcagttgataaagacagcgccaggttcaaatttagtatcatcaatctttttcatgttgatgcctgagcaagtacttgtttatggtgattgtgcaattaaccccgatccgtctgctgagcagcttgcagatatcgcgattcaatcggcacaatctgcggcttcttttggtatagagccaagggtagcgatgatcagttattccaccgggaattcaggatcgggctcagatgtcgataaagtgagagaagctacacgaatagcaaaacagaaatgcccagaactgattatcgatgggccattgcaatatgatgcggctgtaatgccaaatgtagctcaatcaaaagcgcccaatagtcccgttgctggccaagcgacagtatttgtatttccggatcttaatacaggtaataccacttataaagcggttcaacgcagtgcagatcttatcagcattggcccaatgttgcagggcatgcgaaaaccagttaatgatctttcgagaggcgccttggtcgatgatattgtttacacaatagcactgacagccattcagtctgcgcagactgcattattggagtaa

SEQ ID NO: 1573 - DNA, 2223 bp, Alteromonas macleodii ATCC 27126
atgggtgatagccgcagaagctgcaaccttcgcgtaaattatataagcaacgccaacgcgttagcaaaagcaggagtaactatgtctcgcagaattatgttgatccccgtaggcacaagtgttggcctaactacggtcagcatgggccttgttcgtgctatcgaggaacaaggcataaagctcaatttctttaagcccgttgcacagccacgtaaaggcgataacggcgaagagcgctctacagcaattattgcgcaccatgccagtgtgtcgcccatcacgcctttcgagcttgaatacgtagagcgaatgatcagtaacgacagcaccgatgagctcttagaggagatcatcgagcggtttgaagaaagcagtgttcaagaagctgttactgttattgaaggactggtgacaactcgccatcatccttatgcagagcgcctgaatttagagattagtcgggcacttgatgccgacatcgttttcgtggctgtgcctggaaatgagtcgaccacagatatcaatcatcgcctcgaaatcgttgtagacacctatggcggtcacaaaagtcaaaaagtagtgggctgtatcttcaataaggttaacgcgtcttttgatgaacatggtcgcttacgcgctgatattggcgcaatagaagcccctgagcacgacgaagagcgaacccaagcgttacgtgatttgcctattttcaaaaagggcttgagtctacttggcacaattgactggagcgctgatttagtatctcctcgcgccaccgacgtagcgaagcatcttaacgctagcttgttaaacgaaggcgagttggctgagcggcgtttaagtagtgtcacgttttgcgcgcgagaaattcacaacatgacgcacaccttaaagccgggggcgctacttgtaatgtcgggtgatcgcggcgatgtttttgtgtcgtgctgtttagctgcattaaacggcacaaagctaggcgcgctcttgcttaccggcggctatcagccagatgaaaacattatggcgttgtgtagccaggccatggaaacgggcttaccggttatgctggtaaattccaatacgtggcaaacagcacaagcacttcacgcttttaatcaggaagtacctgtagatgacagtaaacgcattgaaaaggtgatggttcacactgcggaaagtttagacgcaagttgggtaaattcacttacccaaaaagtgtcgcgccagaaaaaactctctccatcagcgtttcgtttttacctaacaaaccgtgcaaggcaggtaaataaacgcattgtgcttcctgaaggaaacgagccaagaaccgtggtggcggcctctatttgtgccaagcggggtcttgctcgtcctgtattgctaggcgatgaaactgagattaggcgggtagcagaacagcaaggtgttgtactgagcgaaggcgttgagattctctcgccgtcggccattaaaaaagactatgttgagagtttagtggcgctacgcggccataaaggtgtgacggaagtggttgcccaagagttgttagaagataatgtgactctgggcacgatgatgcttcagcaagatgacgtggatggattagtgtcaggtgcagtaaatacaactgcgaacactattcgcccagcgctccagttaataaagaccgctgaaaacgcgtctttggtgtcgtcagtattctttatgctgttgcctgaccaagttttggtttacggcgactgtgcaattaacccagatcccaacgctcaacagctcgctgatattgctattcaatctgcggaatctgcacaaatgtttggcattgaaccgcgggttgcgatgattagctacagcactggttcgtcaggagcaggaagcgatgtagaaaaggtgagagaagcgaccaaaattgcgcaaagccttcgccctgatttacttattgatggtccacttcaatacgatgcagcggctatcgaaagtgtgggcaagagcaaggcaccaaatagccctgttgctggtaaggcaaacgtgtttgtttttcctgacctcaataccggaaataccacttacaaagcggtacagcgtagcttcgatctagtgtgtattggcccaatgctgcaaggcatgcgaaagcccgttaacgatttaagtcgcggtgcattggttgacgatattgtatttaccatagcacttactgctattcaggcggcaggtaacgtttaa

SEQ ID NO: 1574 - DNA, 2145 bp, Pseudoalteromonas atlantica T6c
atggcacgtagaataatgttaatacctgttggtagcagcgccggactcaccagcgtttcactgggtatggttagagccatgcagcagcaagggttaaaagtgaattttttcaaaccgatgggccaaccgcgccatggcgatgatgaaccagagaagtcgacaacgattatcactcagctaggcccaacaaaacccgcaacccccttaacctcggcgtatgttgaggacatgatcagcaatgacaagatggacgtgttattagaagaaattatcgccttatatgaaacacactatgcagacgaagacattggtattatcgagggattagtgtctaccccaagtcatccttatgcagtgcgcctaaaccgcgaaatttgtaacgcacttgacgccaaaattgtgttggtgagttcccctagcaacctcacaatgaaccaactcaatgataaattagagatagtggcagataactacggtggtcacagaagtaaaaaagtgctcgggtgtatcttcaataaaatcaatgctccattggatgttcgtggccatttaagcactgaactactggaaaatcatgacgagagcaaaaccgccgagataatcaaacgacttgaaaatctgcccatttttaacaaaacgtttgcccttcttgggtgcataagttggagcttcgatttaattgcacctcgggtggatgatttaagaaaacacctgaatgcaaagttactcaacgaaggcgattataaacaccgcagattacgcagcgtgaacctatgtgcccgtgagatccacaatatggtgtgggtattaaaacccggcgcattgcttgttatttcaggcgatagaaacgacatgtttgtgatggcctgcctagcggctcaaaacggcaccaaaatcggggctattttgctaaccggtgggtatgaacctgacccaagagtaatggcattgtgctcccaagccatggaaaccggcttacctgtgatgctggtagatgacaacacatggcaaacatcactaaatttacacttttacaacttagaagtgccggttgacgatgagcaacgcatcaaccgtgtgatggatcacgccgccagttgtattgatccccattggataaactcactaagcgctggcgcgtcaaaagccctacggttatcgccccctgcatttcgttttaaactcacccagctagccaaagccgctaacaaaaccatagtgctccctgaaggtgatgagccacgtaccataaaagccgcggcaatttgtgccgagcgcggcattgctaattgcgtattgttgggctacaaagtagaaatcttaagagtggccgagcagcaaggcgttgtgctgccagattcagtcaccatacaacaaccacaggacatacaggcgcattacatcgccccgctggttgagctgcgcaagcacaaagggttaaccgacgtggtagcgcaagagcaactgctcgataacgtcgtacttggtaccatgatgttaaagcaaggtgatgttgatggcttagtgtctggcgcggtgcataccacagccaataccatacgccctgccctgcagttaattaaaaccgcacccggggcgtctttggtgtcgtccatcttctttatgctgctgccggaacaagtactggtatacggtgactgtgcaattaatccagacccgactgccgagcaactagcggatattgccatacaatctgctgactcagccgctgcgtttggtattgagcccaaagtcgccatgatcagttacagcacgggcacatcaggcactggggttgatgtagacaaggttaaaaaagccacggaactggcacaacaaaaaagacctgacttgttgattgacggcccgttgcaatacgatgccgctgtgatggaaagtgttgccagtaaaaaagcaccgaattcaaaagtagccggccaagccaccgtatttgtgttcccggatctcaatacaggcaatacaacctacaaggctgtacagcgcagtgctaacttagtcagcattggccctatgctgcaaggtatgggtaagccagtgaacgacttgagccgcggggcgctggtagacgatatcgtatatacgatagcgctaacagcgattcaagcgacgcaactaaatagctaa

SEQ ID NO: 1575 - DNA, 2154 bp, Alteromonadales bacterium TW-7
atggcacaccgtattatgttgataccgatttctacgggagttggtttaacatctgtttccgtcgggcttgtgcgtgcgcttgagcaaaaggcggtaaaagttaatttctttaaacctattgctcaaccgcgctctggcgaaaccggtccagaaaaatcgacacaaataataaagcaaggctcccctattgacccaccaacaccgtttgcattggattacgcagagcaaatgattggtgatgcaaagggcgacgacttattagaagaaattgttgagcgctttgaaagtaaaattaacgacgatgaagtagccattattgaaggcatggttccgactcgtaaacaaccttatgcagggcgcgtaaaccgtgaaatagcgcaaacactcggcgcagatattgtatttgtattaacgcctggtaacgataatattacccaacttgaagatcgtcttgagattgctgctggtaattacggtggtattgaccacccgcgtgtattaggctgtatttttaataaagtaaatgcccctctagatgaagaaggcagagcacgcgccgatttagtcgactcttacaaacctgatgaagtagataacgaactaaaccgtttagcatcactgccaatttttagaaaaaacccatttatgttacttggtgcaataccatgggattttgatttagtcgcaccacgtgtgaaagacctaagtgcgtatttaaaagccacaattattaacgaaggtgacatgctgcatcgacgcctgcgtcgtatcacattttgtgcacgtacagtgtctaatattttaaaccatttcacaccaggtgcactattagttactcctggcgatcgctctgatattttagtagctgcgtgtttatcggcaatgaatggtactaaaattggggcaatactactcaccggtggttttatgccagaacagcgtattatggcgctgtgcgaacaagcaatgcaaactggcctcccaattttagcaacagaagccgatacatggcgaacatcgttgttacttcataactttaatatggaagtgccaagcgatgatgaccaacgtatagaaaaagtgaaaagccacaatgctgaatatattgactcagattggctgaactcactggcaaaaaatgtggggaaaacacgtaaactctcgccaccagctttcagatacttacttacagataaagcccgtaaagcaggcaaaacggttgttttacctgaaggcaacgaacctagaactattaaagcggctgctatctgtgggcaacgcggtatagcaaaaaccattttattaggtgatcgcgaagaaataatgcgtattgctgagcaacaaggtatagagctcaacgaaaatgtaagtattgtagaaccaagcagcatcattaatgattatgtcgagcctatggtcgaaatccgaaaaagcaaaggtctcactgctgttgtagcgcaagaacaattactcgataatgttgtactaggtactatgatgcttgaacaaggcaaagttgacggacttgtttcaggagcagttaacacaaccgctaatacaattagaccgccattacagctcatcaaaacggccccgggctcatcgcttgtatcgtcggtattttttatgttgctgcctgatcaggtactcgtttacggagactgtgcaattaacccagatccaaatgctgagcaacttgctgacattgcgattcagtcagctgactcagctgcagcttttggtatagagccgcgtgttgccatgatcagctacagtacaggtacatctggtacaggagccgacgttgaaaaagtgcgagaggcaaccaaaatagctcaacaaaaacgtcccgatttgattattgatggtccccttcagtacgatgcagcaattatggaaaacgttgcgcttaaaaaagcaccaaatagccccgtagcgggtaaagcaacggtgtttattttccctgatttaaataccggtaatacaacctataaagccgtgcaaagaagcgcagacctcatcagtattggtccaatgcttcaaggtatgcgtaaaccagtcaacgatttaagccgtggtgcattagttgatgacattgtatacacaatcgcacttaccgctattcaagcagcgcaagtcgaagcacttaattaa

SEQ ID NO: 1576 - DNA, 2148 bp, Pseudoalteromonas tunicata D2
atgtctcatcgcatcatgcttattcctgtttcaacgggagtgggtttaacctctgtatcggtcggaattgtccgtgcgcttgaacaaaaagcggtccgggtaaacttttttaaacccattgcacaaccaagagcgggcgaaagcggccctgaaaaatcaaccgaaattgtcaaattaggttcaaacatcaaaccaccgatgccgattgaactgaaatatgctgagcaaatgattggtgatggtaaaggtgatattttactcgaagaggtgatagctcgctttgaagaaagtgtgcacgatggtgaagtggcgattatcgaaggtatggtgccgacccgaaaacaaccttatgctggtcgactaaaccgtgaaatagcgcaagcacttggggccgaaattgtatttgttttaacaccaggcaacgatccgcttgatcaaatagaacaccgcttagagattgcagcaagcttttatggcggcgttgaaaacgagcgtgtccttggctgtatttttaacaaagtgaatgctccccttgatgaagaaggtcgagctcgtgcagatctggcagaacaattcgatccagaaaaccttgttgcagaacaaaatcgcctagcggccatgccgttatttagaaagcatccatttaaattactaggttcggtaccttgggattttgagctggttgcaccacgagtctctgatcttgcgcgttacctcaaagccgaaattctcaatgagggtgattttgctcaccgtcgcctgcgcagtgtcacattttgtgcgcgcacagtatcaaatattctatgtcattttacccctggggtattgttagtcacaccgggcgaccgctctgatgtattagttgctgcctgtttatctgcaatgaatggcactaaaattggcgcaattttattaacgggtggctttatacctgaagataggatcatgaaactatgtgaacaagcgatggccactggattaccaatattatcaacccaagcagatacatggcgcacatcattgttactgcataattttaatatggaagtaccaattgatgatgaacagcgcattgaacgagtaaaagaccataatgcagctcatcttgatgccgattggctccaaagcttaactaaaggggtcgaaaaaactcgtaaaatgtcaccacctgcctttaggcatttattgacaactaaagcacgattagccaataaaaccatcgtattacctgaaggtacggagcctcgcaccatcaaagcggctgcaatttgtggcgaacgcggcattgcaaaaaccgtattacttggcgagcgtgaagaaattttacgtattgctgaacaacaaggtgtacaacttaatgacgctgtaaccattattgacccggttgatgtgcgtgaaaactatgtagcacctctggtagagcttcgtaaaaacaaggggatgaccgaggttattgcacaagaacaattactcgacaataccgttttggccaccatgatgctggcgcaaggtcaagtcgacggattagtgtcaggtgctgtcaataccacagccaatacaattcgcccgccccttcaacttgttaaaacagcgccaggttcgtctttggtctcgtcaatattttttatgctattacccgaccaagttttggtttacggcgattgtgcaattaatcccgacccaacggcggaacaattagctgatatcgccattcaatcggcagattctgcaatcgcttttggtattgatgccaaagttgctatgatttcttacagcaccggcacttcaggtgtcggggcggatgttgagaaagtaagattagcaaccgagcttgcacaagcaaaaagaccagatcttattattgatggcccactgcaatatgatgccgcgattatggaaagtgttgctcgcaaaaaagcgcccaatagtttagttgcaggcaaagctacggtctttattttccccgatctcaatacgggtaataccacctataaagcagtgcagcgaagtgccaagctcattagcatcggcccaatgttgcaagggatgagaaaaccagtgaatgatttaagtcgtggtgccttggttgatgacattgtttacactattgcactcactgcaattcaagcaactcaagttacccattaa

SEQ ID NO: 1577 - DNA, 2121 bp, Colwellia psychrerythraea 34H
atgccacatagaattatgttaatccctgttggctcaggtgtcggcttaaccagcgtatcgttaggtttattacatgcctgtcagcaaaaaggaattaaagtaggacacttcaaacccattagccaaccttcgaggaacagcttagctaaaaaaaacaaaacaattgatgccattagcctgtctcaaaatagcactagcgtttcgcttagttatgtagaggggaaaatgggcgatggacttcacgatgttgttttagaagaaatcgttgcgaatttcaatgcgtttaaagaagatcacgacgtcatcattattgaaggtctagtccctacaccaagacaaccttatgctggtcgcattaaccgtgatgtagctcaagcacttggggcaaatattgtcttagttgctagcccgggaaatgacagcgccgaagaatttgaagatagacttgaagtcagtgccgagacctatggtggtataaagaaccgacacctcattggttgtgttatcaacaagctcaattgccctgaccaagaagaatttggtttattacccaaagaagaagaaattgaaaatgattttaatctaaaccattggttagatttatcaatttttaaaggcagacactttgatttacttggcacggttcaatgggaaattgatctcatcgctccacgtgtttgtgatatcagtaactaccttgaagctaaagtaattaataatggcgatatggaacatcgtcgttttcgcagtgtcgcattttgcgcccgaaccgtatcaaacctagtgagttacttggttcctggtcgactcattgttacgccaggtgatcgcaccgatattattattgctgcctgtttatccgcgttaaatggtactaaattaggtgggttgattttaaccaatggctttgaaccatccgagcaagtttgggagctatgtaaacaagcacttgatgcgggtttacctgtcttatctgtaccttgggatacttggcaaacatcacgtcatatcatgggctttaatcctgaaatacctaaagacgatatccaacgccaagataaagtaaagcaacatgtagccgataatttaagtagtagttggcttgaaagcctgacctcgaaaaacaatagttataacttattatcaccgcctgcttttagacataaattaaccgagctagctcgccaagcaaataaattaatcgttttacctgaaggaacagatatacgtaccattaaagcggctgcaatttgctgcgaacgaaacattgctcgctgccaactaataggtaacaaagaagaaatacttcagattgctgaacatcaaggtattaacttaccagataacttattaataacagatcccgactccattagagataattacgttggacctatggtcgagctacgtaaaaataaaggcctaacggatgttattgccctagaaaatttaaaagataatgttgttttagcgactatgatgttacaacttggccaagttgatggcctagtttctggcgcagtaaatacgacagcaaacaccataagacccgctttgcagttaatcaaaactgcacctgacagctcattagtttcatcagttttctttatgttactacctgatcaagtacttgtttatggtgactgtgctattaaccctgagcctaatgcagaacagttggctgatatagccattcaatctgctgactcagctagagcatttgatattgaaccaagagttgccatgatcagctacagtaccggcagatcgggtcatggtgctgacgttgagaaagttgctaaggccactgaaattgctaaagctaagcgacctgatctcattattgatggaccactgcaatatgatgcggccattatggagaatgttgctaagaaaaaagcgccaaatagcccagtcgcaggtaaagcgacagtattcatattccctgatttaaatactggtaatactacttacaaagcagtacagcgttcagctgacttagtgagcattggacccatgttacaaggaatgaataaacctgttaatgatttatcacgcggcgccctagtcgatgacattgtttatactattgccttaacggcgatacaagcgaccatgtag

SEQ ID NO: 1578 - DNA, 2100 bp, Marinomonas sp. MWYL1
atgtcaataaatgtactaatgaccgttcctacgggcccaggcgtcggcctaacatccgtctctgtaggtcttgtccgcgcacttgaacaacaaggattaaaagccagtttcttcaagcctatcgcccagcctcagcctggtgataaaggaccggacaaatcaacggctatggttgctcaaggttcaacactaacacctgctgagccaattccgctccatgaggctgaacgttatttgtacaacgataatatcgacgaactcatggaagagattgttggccgttttcaagccagcgttgagccagattcaacggttattgtagaaggtcttgcgcagatcgccgggcacccatatgcaacaaggctaaataaagccattgctagaacactagacgcaggcttagttttagttactgcaccgaacaacatgagagtgaacgaacttgaacatcatgttgaaattgccgcaggctcttacggtggtataaaggctaacgatgttattggttgtattttaaataaaactacaccagggtcattaggcgttaaatcctacggtgatttgtttgcccaaagaggaatttttaaacgcaactttagtctgctcggtcaaataccgaaagcggacgagctaacctatcctcgtgttaaagatgtggctgacttccttggtgctcgtattattaatgcgggtgaaatcgaatctcgccgagtacaatcttatacactctgtgctcgcggtgtggaaaatatgctcgaagctttgcgaccaggcgtattggttttcacgcctggagatcgtactgacatcatcatggcgactgctattgcagcgcttaatgatattaaaattgcagcattagtggttactggcggttaccagccaagtgaagctctaatggcgctttgcggtaaagcaatggcaaaaggattgccagtcctctcagttgaatccaacagctgggaaacagtgattaatatgcagtcgttcaaccaagagattccacttgacgataaagaacgcgtcctgatggtgaaagagcatattgctcgttgcattgatcacgattggataaactcttttgccttaaaccaagaagaaagaaaattatcccctcctgcattccgattccgcttaattgagctcgctcggtcattaaataaacgcattattcttccagaaggtgaagaaatccgcaccattcaggcggcgtctatttgtgcggaacgtggcattgctcgttgcacattattaggtaacgaaaccgaaattctccgtattgctcaaaacaacggtattgaattaagccatggtgttgaaatactcgaccccaacagcattcgtgaacgttacgttgcaccaatggttgaattgagaaaaagtcgcggacttaccgatattgtcgctcgcgaacaacttgaagataatgtggtattaggcaccatgatgctgcaagctggtgatgttgatggtttggtttcaggtgctgtacacactaccgccaacactattaggcctgcactgcaactaataaagacatctcccaactcaaatcttgtctcatctattttcttcatgtgtttgccggatcaagtactggtctatggtgactgcgctataaacccagacccaacggctgagcaactcgcagaaattgccattcaaagtgctgactctgctgcagcatttggcattgccccaaaagtcgccatgattagttacagtactggtggttctggtacaggtaatgatgttgataaagtccgagaagcaacggctatagcacaaaaacttcgcccagacctgttgattgatggacctctgcaatatgacgcagccatcatggaaaaagtagctaagcaaaaagcgccaaacagcaaagttgcaggaaaagcgaccgtatttattttccctgatttaaatactggtaacacgacctacaaagccgttcaacgaagtgctgatgtggtcagcattgggcctatgctacaaggcattcgcaaacctgttaacgatttgtctcgcggggcattagttgacgacattgtctacaccattgctattaccgctattcaggctggcaagcttaaaagcgaatag

SEQ ID NO: 1579 - DNA, 2076 bp, Marinomonas sp. MED121
atgacagtaccaacaggtccaggtgttggccttacttcagtctcagttggactggtccgggcacttgaacagcaggggcttaaagcaagcttttttaaacctatcgcccaaccaagacctggcgactttggccccgatcgatccaccgctatggtagcccaaggctcaaccttaaccccagcagaccccattcctcttcatgaagcagaacgctttttatacaacgaccaaattgaagagctaatggaagaagttgttgctcgctttcaatcaagcattgaagctgatagcacggttattattgaaggccttgcacaaattccaggccacccctatgccactcgtttaaacaaagccatagcaaaaacccttgatgcctcattagtattggttacagcacccaataatatgcgagtgaacgaattagagcaccacgttgaaattgcagctggctcttacggtggcattaaagcggaagatgtcatcggctgcattttaaataaaaccattccaggttcactgggagcaaaatcctacggggactcttttgctcaacgccctatctttaagcgcagttttaacctcttggggcaaatccctaagacagaggagctgacttacccaagagcaagagacgttgctgacttcttaaatgcgaaagttattaatgcaggcgaaatggacacccgtcgtgttcaatctttcactctttgcgcccgtggtgttgaaaacaccttgcccgctcttaagccaggtgtcttagttttcacaccaggggatagaacagacattataatggcaacggcaattgccgcacttaatgacacaaaaatagcagcactcgttctcacaggaagctaccagcccagtgaagagctgttaaagctttgtggtaaagccatggcaaaaggccttcctattttatcggttgatactaatagctgggaaacagcgatcggcatgcagtcttttaaccaagaaatcccacttgatgatagacagcgtatttccttagtaaaagagcatatggcacgctgtatcgatcatgaatggatcagttcatttgccttaaaccaagatgaaagaaagctctcaccacccgcctttaggtacaagttgattgagcaagcaagagcgcttaataaacgtgtcgtactaccagaaggagaagaaattcgtaccattgaagccgcctctatctgtaccgaaagaggaatagctcgttgtgtgttactaggtgataaagcacagatacaccgcattgcccataacaatggcattgaacttcacccagacattgaaattttaagccctaattccattcgtgatcgatatgtcgcccccatgctggaaatcagaaaacataagggtttgactgatattgttgccaaagagcagctagaagataacgtcaccttaggtaccatgatgttgcaaaccggtgatgtagatgggctagtatctggcgccattcacacgacagcaaataccattcgccctgcactccagcttgtcaaaacatcatcaaactcgtctttggtatcctcagtgtttttcatgtgtttacctgatcaagttttggtttatggggattgcgccattaaccctgatccaagtgccgagcaattagctgaaatagcgattgaaagtgccgactcagccattgcctttggcattccagcaagagttgccatgataagttacagtacaggtggatcaggcgccggcaatgatgtcgaaaaggtgaaacgtgccacggaacttgctaaaacaaaacgccctgatttattaattgatggcccccttcaatatgacgctgccatcatggaagatgttgcaaaacaaaaagcacctaatagtaaagtagcaggacgcgcaactgtctttatcttccctgacttaaataccggtaataccacctacaaagcagtacaaagaagtgctgatgtcatcagcataggacctatgctacaaggcattcgaaaacccgtaaatgatctttctcgcggcgccttggtggatgatattgtctatactatcgcgattacagctattcaatcaggccataacccttaa

SEQ ID NO: 1580 - DNA, 2058 bp, Dichelobacter nodosus VCS1703A
atgacaaaatcaatacttttagttgcaacccatcgtggcgcgggattaacttcttccgttttaggattgagtcacgctattgaaaaattaggcgtaaaagtggcattgcataaacccgttttgcaatgcgcttgcgaggcatcatgcgcttgcaattctgcagcaacctgtaccgatcgcgcgttatccatttcgccagaacgcattcaacaagctttaaaaaatcagaaaatcgatgaattgatggaagaagccttacaacatttcgtcgccgctaaagccgatgccgatatcgttgtgatggaaggattattggaaacgcctaacgcgccgtatgctcatttaatcaaccaaaaaatcgcgcgttcattgggcgccgacgttatcgttgtgagcagcgcagatgtagaaagtatcgatcgtttagaaagacgtttgagctttgccggcgaatattttgccggacgtttattaggcgccatcatcaatcgcgtaggcggcgaaggcaatttaacgcaagaatgtttacaaaaaagcagctgctttaatgatgcattacctttacttgccaccatttctgaaaatgcagagttagccgcaccgcgcgtgctcgatttgcaacgtcatttagacgctgaaatattattttccggcgaaatcaacagccgccgaatttatgactacgtattatttgcgcgcagcgtgcaaaatgcgattcctgttttgcgcgacggcgtgtgcgttttttcgcctgccgaccgtgacgatactttaatggcagtaaccaccgccgtggcttctggtacgcatttggcgtgtttggttttaaccggtgaagaacgcagcgatgatgcggttatgcgtttgtgtaaaccattgttagaaaaatcaaaattaccggtgttgcggattaaacgcgacagttgggaaagtactcgcgcgatggaaggatttaatgcgcatctcgccgcagatgataaagaacgcatcgaaaaaatccgcacattttttgttgagcacctcaataaagaatggattaaaaattatgttgcgcgcggcgacgaacaacgtctttcacccgcagcattccgttataacgtggtgcaaaaagcgattgcagcgaaaaaaaccatcgttttacctgaaggtgatgaacccagaaccgtggttgctgccagtcaatgtgcggcgcgcggcatggcaaaatgtgttttattagctaaaccagaacgcgtgcacgcagttgccgccgaacaaggcgttactttaggcgacggcatctccatcattgatccggaacaagcccgcgaacaatacgttgcccgtttggtggaattgcgtaaacacaaaggcatggacgaggctactgcccgcagtcaattagaaaataatgtgatgttgggcacattaatgttggaagctggcgaagttgatggtttggtttctggcgcagtacacaccaccgccgataccatgcgtccgccgttgcaattaattaagacggcaaaaggcgcgagcatggtttcttccgtctttttcatgtgtttgccggaacaagttttggtgtacggcgattgcgcgattgttcccaaaccaactgttgatgatttggcgcaaattgcgattcaatcaaacgatactgccaaagcctttggcattgaaccgaaagtggcaatgatttcttattcaaccggtaattcaggtcaaggtgaagacgtagaaaaagttaaagccgcaacggcaaaagtgcgggaattgcgtccggatattatcgttgatggtccaatgcaatacgacgccgcgtcagtggcttcagtaggtcgcgctaaagcgccgaacagccccgttgctggacaagcaaccgtattcgttttccccgatttaaataccggaaatactacttataaagcggtgcaacgcacagcgcacgccgtttctatgggacccgtattgcaaggtatgcgtaaaccggttaacgatttatcgcgcggcgctttgattgaagatattgtttacaccattgcgctgactgccgttcaagcaacattagctgaatag

SEQ ID NO: 1581 - DNA, 2115 bp, Cardiobacterium hominis ATCC 15826
atgcgctcagcgcgtaaggagggcgacatggcaaaagcaatcctcgtcgtcgccacccaccccggcatcggcctgacttctaccgttctcggcctctaccacgcccttgaccgcaagggcgtcaaggtcggcttccacaaaccggtgatgcaatatgacgtcgaaagccaggacgtcgatcacagccgcgccgtgctgctgcactcctcgcgcgccgtcggcgatgacgcgctggtcatccgccccgaagcggtgcaacaggcgctggatgcggacaatctcgacgaactgatggaaaccgtcatccagaactttgaagcggccaaaggcgatgccgacgtcgtcatcatggaaggcctgctggaaacgccgaacgtcccctacgccggcgaatgcaaccggcaaatcgcccgcgcgctcggcgcagacgtcatcctcctttccgacgcgcgcgtctccagcatcgcccgtctggaaaaccgcctcgacttcgctgccaacgccttcggcggttacgaaaaaggccacctgctcggcgcgattgtgaactacgccgacggcgccggcgcgctcagccgcgccgaaatcgaaaacagcaaagccttcaacgccaacttcaaactgctcggcgtcatcagcagccgtccggaaatcgccgcgccgcgcgtcagcgacctgcaacaacacctcgatgccaccgtcctctttgaaggcgaaagcagcacgcgccgcatcctcgattacgtcctctttgcgcgcaccccggccaacgccgccgacttcctccgccccggctactgcatcttcctccccgccgaccgcgacgacgcgctgatggcaaccaccatctccgccaaagcaggcaacaacctcgcctgcctcgtcctcaccgggccgctgcccgcctccgacgtcgtcatgaacctgtgcaaaccgctgatcgaagaagccaaactgccggtgttgcacctcggcaccagcagctgggaaatcagcaaactcatcgaaaaattcaaccgctacatcccggtcgatgacgaacagcgcatccgcgagaccaaagaatacttcgccgacggcatcaaagacgactggttcgcaggctacctcagcgccgcgcgcagcgtcagcctctcgcccgccgccttccgttaccaaatcgtgcagcgggcgattgccgcacaaaaaaccatcgtcctgcccgaaggcgacgaaccgcgcaccgtagtcgccgccagcatctgcgccgaacgcggcatggcgcgctgcgtcctgctcgccaaacccgaaagcgtacaggccgttgccgcacaacaaggcgtcacactgggtgataacatcaccatcatcgaccccgccgccgtgcgcgaaaaatacgtcgcccgcttggtagagttgcgcaaagccaaaggcatgaccgaagaccaggcgcgcgaagcgctcgaagacggcgtcatgctcggcaccatgatgctcgaagcgggcgaagtcgatggcctcgtctcgggcgcggtacacaccactgccaacaccatccgcccgccgctgcaaatcatcaaaaccgcccccggcgccagcatggtgtcttccgtctttttcatgtgcctgcccgaccaagtgctggtctatggcgactgtgccatcgtccccaacccgaccgcggacgaactcgcgcaaatcgccatccagtcgaacgacagcgccaaagccttcggcattgagccacgcgtggcgatgatttcctactccaccggcagctccggctccggcgcggacgtcgaaaaagtcaaagaagcgactgccaaagtgcgcgaactgcggccggacatcctcgtcgatggcccgctacaatacgacgccgccgccgtcgaatccgtcggcaaacaaaaagcgccgaacagcccggtcgccggacaggcaagcgtcttcatcttccccgacctcaacaccggcaacaccacctacaaagcggtgcagcgctctgccaacgccatctcgatgggcccggtactacaaggcatgcgcaaaccggtgaacgacctctcgcgcggcgcgctggtcgatgacatcgtctacaccatcgccatcaccgccgtccaagcggcacattcctga

SEQ ID NO: 1582 - DNA, 2316 bp, Phytophthora infestans T30-4
atgtggacgctccgccactccctgcgtcgctccgtgggcatggcgctgccccatcgtcgcgcactgaccgccgccgccatctcgcagggcaaagtgcccatcaacaacctctacgtgacctccacggaggtgacaaagaagacggcgcctgtgctcatcggtctggcccatgttttggagcaaaagtttaccaaagtgggctatttccgccccattcagcccagtccggactcgagcatggccgaccaccacgtcgacgtcatgaagcaccaactggagctctccaaagacgtcgaggagctctacggagtcaccagttcccgtgccatggaggccatgctcactggcaagggagacgacatcgtggaggaaatcctggagcgatacgaagaatgtcgcaagggccacgactttatgatcatcgaaggctcgcaagtctccaaacacgagagtgccatgagctggaaaatcaacgtggacattgccaaagccattggctccccggtcctcatggtcacggatttcggagacacatccgcctcgagcaacgcgcttctagaggaaatggtctcgcgtactgtcatgggcagagaccaagcagaagctgcgggactcaactaccttggcacaattgccaaccgcgttcgagccaaagacgtggcaactctacgcgaagacctaaaactgaaaatgggtaagaaagagatcccatttttgggctttttgccaatggatgaaattattgcatccaagcgactgaatgaagtgacacaccagttgggtgcaaagcaacttttcggcaactcaattgcaaatgacgcggtcgtaacttccgccgtcgtggcggccagtgcactgaaagatctgttcgcccacttgaagaaatacaaagatggggctatgatcatcacgtctggagatcgctccgacctcatgttgggcttgatggtttctcgcttgccaggggtgttgccgaacatctcggctatcgtgctgacgaacggtaactacccacacagcaacacgcaagagattctcaaaggcgtggaggcactggacaagactggtctctctcttccgatcttctcaaccccaaacgacaccaactccactgctgatggatttgccaaagtgtcaacctacattttaccttcaagcaagttgaaaatcgaccgctccaagcaacttttcgacgaatttgtcgagaaagaaatgctgatcggtgaactggacgaaggaatggtggtcagccgctctccgaagcagttccagcactttttgttcagcaagtcgcgagctgtccagcgtcatattgtactgacggaaggagaggacattcgcgtgctccaagcggccgatcagattctacgccagaacttgtcgaggatcacgattctcggagacccggacgagatcactgtgaacgccaagatggccaatctcgacttgtcacgcgccaatatcatccgtccagtagacagtcacttgctggacaagtacgtcgactatttctatgccaaacggaagcacaaaggtgtcacgagagagctggctcgcgactactgcaaggacgagacgtacttcggtacacttatggtggaactcggtgatgccgacgggatggtctccggtgcgtgccacaccacagccaacacgattcgtcctgctctgcagctcatcaagacgacgccgaaccgaccgattgtgtccagtatcttcttcatgtgtctcaaggacggcgtgcgcatctacggagactgcgctgtgaacacggacccgagtgcgcaggacttggcgcagatcgcggtgacgagtgcagagagcgcagaagcgttcggactcatcccgaaggtggcgctgctgtcgtacgccacaggcgactcgaactcgggtccgatcatcgacaaggtgcgcgaggcgaccaagatggcgcaggagttgcgtccggacttggacatctacggcccgatccagtacgacgctgcggtggacgagtcgatcgccaagaccaagttgaaggcgatccccagtggcgccaaggttggcggccaggccaatgtgctgatcttcccggacttgaacacgggcaacaacacgtacaaggctgtgcagcagagtactggctgcatcgcgatgggtccgatgctgcaaggtctgcggaaaccagtgaacgacttgagtcgaggcgccacggtgaaggacattgtcacgacggtggcgatcacggctattcaggcggaccaggtgatcttgaaacgagaagcagagaactccaagaaccaaaatggggaatttcttgagagtgcaacaatgtga

SEQ ID NO: 1583 - DNA, 2286 bp, Phytophthora infestans T30-4
atgtggacgctgcgcaacaccttccgccgcacgtcggtggcgcttccctcccagcgtcgcgcgctgaccgctgccgccatcgcagagggcaaagtgcccattaacaacctgttcgtgacgtccactgaagtaacagagaaaacggcaccagtgctaatcggactgaccaacactctggagcaaaagtttgccagagtgggctacttccgccccatccagccgattgtcgagactgaccaccacgtcgacgtcatgaagcagcagctggggctcaccaagagcgtggagcagctgtacggagtgacgagcgagcgtgccatcgagtattggctgaacggcaagggagacgacctcgtggaggagattctcgaccgctacgaggcgtgtcgcgagggccacgatttcatgataatcgaagggtcgcaactttccaaacacgaaagtgccatgagttggaaaatcaacgtggacattgccaaagccattggctcacccgtgttgacaatttccgatttcagcgaatcggcaaacacgaacagcgaccttttggaggagatcctctcgcgtactgcttttaacaaagaccaagtggagggtgcgggtcttaacttcattggcaacattgccaaccgcgtgaacaccaaagaccccaaggctttacgcgaggcaattcgtgccaaattgcgtgaaaaagatttgccattcctcggctttttgccaaaagacgattttatcgcgtccaaacgtctcaacgaagtgacacaccaactcggagctaagcaactctttggcaccaaggcaatccccaacaacgtcgtcgtaacttccgccgtagtggcaacaagcgccttgaaagatttattcgcgcacttgaagaactacaaagacggtgctctcgtcatcacatcggcggatcgctcggacgtcatgctgggtctcatggcctctcgtctgcctggtatcttgccgaacgtgtcggctatcgtgctgaccaatggcagctacccacatagcaacacgcaggagattctccagggcgtggaggctctggacaagactggcctgtccatcccgatcttctcggtgccagaggacacgttcacaacggctgacaagttctccaaggtgtcgacggacattctacccaccagtcagctgaaaatcgaccgctccaagcaacttttcgacgagtttgtgggcaaagagggcatcattggcgaactggacgaaggaatggtggtcaaccgctcgccgaagcagtttcagcactttttgttcagcaaatcgcgagctgtccagcgtcatattgtactgacggaaggagaggacatccgcgtgctccaagcagccgaccaagtgctgcgtcagaagctctcgaaggtgacgatcctgggcaatccggacgacattgaacgacacgccaagtcgctgactctcgacctctcgcgtgcaaacattgtgcgcacagcggacagcgagctgctggacaagtacgtggaccagtactttgagaagcgtaaacacaagggcgtgacgcgggagtcggcacgtgacgcggtgctggaggaaacatgcttcggtacgatgatggtggagatgggcgacgccgacgggatggtctccggtgcgtgccacaccacagccaacacgattcgtcctgctctgcagctcatcaagacgacgccgaaccgaccgattgtgtccagtatcttcttcatgtgtctcgaggacggcgtgcgcatctacggagactgcgctgtgaacacggacccgagtgcgcaggacttggcgcagatcgcggtgacgagtgcagagagcgcagaagcgttcggactcatcccgaaggtggcgctgctgtcgtacgccacaggcgactcgaactcgggtccgatcatcgacaaggtgcgcgaggcgaccaagatggcgcaggagttgcgtccggacttggacatctacggcccgatccagtacgacgctgcggtggacgagtcgatcgccaagaccaagttgaaggcgatccccagtggcgccaaggttggcggccaggccaatgtgctgatcttcccggacttgaacacgggcaacaacacgtacaaggctgtacagcagagtactggctgcatcgcgatgggtccgatgctgcaaggtctgcggaaaccagtgaacgacttgagtcgaggtgcgacggtgaaggacattgtcacgacggtggcgatcacggctattcaggcggaccaggtgatcttgaaacgagaagccaaggccaaggtggaggctgcagcctag

SEQ ID NO: 1584 - DNA, 2379 bp, Chlamydomonas reinhardtii
atgtctctgaacagtagcactatgtcgcgccggcaggcggtggccggggccccggcagtggcgccgttccgacacgccgggctgttcccgcgcgtcaggctctgcgcgaaccgccgggtggcgcgtgtggcgccgaaggcagcgggcaacggcaatatcgcacagggcgagcagggctttgacaccctcttcctctcggacatctccctagtgggccagcgcacgcctctgctgctgggcttcttcaactacttcgagcgccacctcccgcatgtgggcttctttgagcccattgccgccgaggcgctagcgtcgtcggagctgcgtattgaccgccacgttgagctagtgtacaaggtgtttaacctcaagggcgacgtgcgcgccatgacgggcgtgcaggacgccgaggccgcgcggatgatcgccaacggccagcacagcgagctgctggacaagatctacagccagtacgcctcgtacaaggaggggcaggacctggtgctggtggaggggccaggcccgctcatgggcggcacggagctggacgcgcagatcgccgccgccctgaacgcgcccgtgctcatgactatgaccggccagcccaacgcgaccgttgccgactactacaaccgtgcgatggtgaagcggcaggtgttcctggaccaccacgtggaggtgctgggcctggtcatgaacgggctgccgcgccagtctcacgccatcctgtccggccagctccgggacaagttcgcggcggcggggctgcccttcgccggcgccatccccaccgacatcatgctgcgcaacgtccgcctggacgaggtccagaccgccatgggtgcccagcggctgtacggcgacagcctgctgacggacgtggagttcgacgacgtggtggtggccagccagcgcctggaggagctgctggagatcctggcggagaggcccatgggcaggccactcgtggtcacctccgcggaccgcctggacatcgtgctggggctgctggcggcacagctgtccgtgtcgggccccggcgtggccggcatcctgctgacgcaggccggctccgcccgctccggccgcaactacgcgcgtgacaccatcgaccgcatcttcgccggcctgtcaagcagcggcctgtacaagggcagcctgctgccggtgctggtgacggacatgccgctgcgtgacgccatcagaaagctggacaacctggacgccgccatcctgccctcatccacgcgcaagatctcgcagtgcaagcgcctgttcgagcagtacgtggacgccaacgcggtggtggcgcggcttcagaacatggtgcgccccaaccgcatgacgcccaagatgttcatgcacacgctcaagtccatgtgcaacgccacgccccagcacattgtgctgcccgagtcggaggacaagcgcgtgctggcggcggcggcggacgtggtgcagcgcggcctggccaagatcacgctgctgggagaccccaccaccatcctggccgaggcggccaagctgggcctggacctgtccggctgcaacatccacaaccccaacacctcggaccggtttgacaagtacgtggacatgctggtggaggcgaggaagaagaagggcatgacgcgcgaggtggcggccgacacgctgcacggcgacgtgaacttctttgccaccatgatgatcgtcgcgggcgacgccgacggcatggtgtcgggcgcggtgcacaccaccgcctccaccgtgcgccccgcgctgcaggtgctcaagagccccgacaccccgctggtgtcctcggtcttcatcatgtgcctgcccgaccgagtggtggtgtacggcgactgcgccgtcaacgtcaacccctccgccgccgacctggcgcagatcgccatcacctccaacgacaccgccgcggccttcggcatcgagccgcgcgtggccatgctgtcctactccacgctgggctccggctccggccccgacgtccagaaggtgagcgaggctgtggccatcgtgaagcagcggcggccggacatcaaggtggagggacccatccagtacgacgctgccattgaccccaaggtggcggcggtcaaggtgcagggcctaagcgaggtggcgggcaaggccaccgtgttcatcttccccgacctcaacaccggcaacaacacgtacaaagcggtgcagcagtccacgggtgccatcgccatgggccccgtcatgcagggtctactcaggcccgtgaacgacctgtcccgcggctgcacggtgcccgacatcatcaacaccatctgcgtcacctccatccaggcctcccgcatgtcatccgccgctcgcgccgcggctgccaaggctgccgtcgcggccgtttaa

SEQ ID NO: 1585 - DNA, 2367 bp, Physcomitrella patens subsp. patens
atgttgcgagctgtgggaaagaaggtgagacgcgttcttcgtgaagaacttctcgctgggttgcagggtcgaggtttaggaaggatttatgacgcgtcgggaacgggcgtgcggaagcatggatggggaatatcctcgcgagaaacccacaccaacagcctttacattcatcacacgattggtggcgttggtcgtgactcggttgcagtgaccgtgggtttattgcactcccttgagagattgcaacccggaataggctacttcaggcccatcgaccaaaccacaattggtggctataggtccaaattgatcaagagcgttttcaaaatgaaagacgatccagcaatcatgcagggggttacgcaggaccgtgcttatgagcttgtcacgaatgacaagattgatgacttgttggaagaagttctcaaagcctatgaagcttgcagggtcaaacacgactttgtagttgttgaggggacaagtttgagaggcggtggtgacgacacagtcacccttaatgccaaaatcgctcaaactctgggatcatcagcattacttgtcacagatgcaggaattgcttgtggcaagatggataaaatgaagaattgggatggatttgactgggagaaacgggttgttaacaatgccaagctgagtgacttggttttcagacgcgaacacgtggatgtggtgggagcaatcgtccatcgtacaccccaaactgaaaggaaagataaactgctccggaaggtgtttgaggaaatgaaaataccatttgtaggagccttgcctgaggactcggtcttgcggtctgtgcaggtacaagatgttgccaaaaagctcgaagcaggactgctatatccagttgaggatgaggaggttgctatgtcaacggaagtcactcaatatcttgtggctactgaacaactatctgatttgcttcgccacttgcctcgatatgttgatccgacgaagggctccatcgtcattacttccgcaaatcgagttgacattctactggggctgatacatcttcacgagtccaagtcgaatgcaaacatagcagccgtggtccttagtgggggcaagcctccaccgagggaggtccatgagttgttgaaggcccggaattcaggcacattgcctattatcctaagtcctcaaatgacatttgaaactgcatctgcacttgcaaatgtggagggctatatctcgtccaaaactcctctgaaggtcgagcgggctcagacgttatttgacgacaacatcaacatgaagcttattaaggatgcaatgttccaggaacgtccggtgcgaatgaactccaagctattccaacataacctcttcacgcgggctaaacaatgcattcagacaattgtgttacctgagggtgaagaacctagaacattacaagcagcaggaactgttctacgaaggggactttgcaatctaattttgctgggagatcgggagaagattgaaactttggcaaaacaatttcgagtggacattagtcaagctcgcattgttgatccaagagattgccctgagactgaaaagtatgccagatatttttatgaatctcgtaagcacaagggaataacacttgggcaagctcacaatattttgataggggatgtgaattacttcggcacttgtatggtagctgagggggctgctgatggtatggtctccggagctgttcatactactgccaacacagttcgtcctgcacttcaactaattaagacacttccaggcattcctgtggtttccagtgtcttcttcatgtgcctacctggaaaggtactggtctatggtgactgtgccatcaactcagatccaacaagtgaagaattggcagcaatagctatagcttctgcagatactgctgctgcatttggaatcaaaccacgggtggcaatgctgtcatatgcaacaggggactccaataaaggtcctcttatacaaaaggttattgatgcaaccgcaattgcaagaaaactacgcccagacttgctgattgaaggacctttgcagtatgatgcagctgttgatcctgtcatagcgaagacgaagatgaaaggggctgaatctgaggttgctggaaaggcgtcggtgctcatctttccagaccttaacactggaaacaatacctacaaagctgttcagcagacaactggggcagtagcaatgggaccattactgcaagggctgagaaaacccgtgaacgacttgagtcgaggttgcactgtaccagatattgtcaccactatcgctcttactgcagtacaagcagctgccatgaaggagaccgcaaaaagggagactccaaaggaaaaccttgtagcttcagcggcgtaa

SEQ ID NO: 1586 - DNA, 2097 bp, Cyanothece sp. ATCC 51142
atgacaaattctatttatattagtacccttgagccaagaagcggtaaatctttaattgctttaggaatgattgaattaattctgagaaaaaccacaaaagttggatttttcagaccgattattcaagattcaattgatcataaacctgataaacacattgacttaattttatcttattttaaattaccccaaagctatgatgattcttttggtttatattattctgaagtcaatcatcttatggaacaagaaaagctagatgagattttagataaaattattagcaaatataagaaattagaagaaaattgtgattttattgtttgtgaaaattctgattatgtaggtgaaaattctgcctttgcttttgagattaatgttgctattgcaaaaacattagggtgttctctattaattttgggaaatggttaccaaaaatctttacaagaaatcagtatttctcttaagattgttgctgatgcttatcgagaaaaacattgtagaatcttaggtattattatcaataaagtttcctcatcagatagaaaaaatttagaaaatcacttagagaaaacctatcgtaaaaataattatttattttcagttattccctatgataaaaagttagatagtcctagaatgaaagaagtagcagaacagttaaaagctaaagttttatatggtgaaaaacggttgaataatttggtctttaattatctcattgctgccatgcaaatgcagcacgcaattacccaattacaggataatgatttagtggtaacaccatcggatagaggggacgttattattggtgcgttgcaagcacatcaatcaacaaattatcctaatttagctggcatacttttaacaacagaatgtgagttagaaaagtcaattggtcgattaattgggggtttgagcgatccgttacccatactttgggtcgatacttatacctatcctactgcctctcggttacaaacggtagatagttctttgaaagcaggagatattgaaaagattaattggagtattgaactctttgatcaatccgtcaatcttaccatgttagaacatctgattaacaagatagaagttgagggaattactcccaaaatgtttacttataatttaattcaaaaagcaaaattaaataaacgtcatattgtcttaccagaaggaaaagatccccgcattcttaaagccgttgctacccttttatctcaagatattgttgatattacagtattaggagaaaaaaaacgtattgaacgtacaatacaaagtcatggtattcaattagatattaataatcttaagattattaatcctttgagttcccctaagttagatgattatattaaaaccttatatgaacttagaaaacataaaggaataaccttagaaaatgcaaaagatatgttaatggatgtgtcttattttggtacaatgatggtgtactcaggagatgcagatggcatggtttcaggggctattcataccacaggaaacaccattagaccagctttacaaatcattaaaaccaaacccgaataccagttagtttcctcggtattttttatgtgtttaggggataaagtattagtgtatggagactgtgcaattaatcctaacccaaccgccgaacagttagcagaaattgctgttatttccgcagaaaccgcccaaactttcggtatttttcccagagttgctttactgtcttattcatcaggagagtcaggaaccggggaagatgtagaacgagttaaacaagcaaccattctcgctcaaaaacgccgtcccgacttattatttgaagggccaatacaatatgatgctgcggtagataagaccgtggcagcgcaaaaaatgccagattcagaagtagctggacaagcaacggtctttgtttttcctgacttgaatactggaaataatacttataaagcagtacaacgggaaactggggcgatcgctattggtccgattttacaaggattaaaaaaacccgtcaatgatttaagtcggggttgtactgtagaagatattattaacaccgtggtgattactgctattcaagggagtgataattaa

SEQ ID NO: 1587 - DNA, 2097 bp, Cyanothece sp. CCY0110
atgaccaattctatttatataagcaccgtcgaaccgagaagtggtaagtctttaattgctttgggaattattgaattaattcttagaaaaacgacaaaagtgggattttttagacccattattcaagattccattgataataaacccgataaacatattgacctcattctatcttattttaaattatctcaaacctatgaggattctttcggtctacattatgctgaagtgaatcatctgatggaaaaagaaaaattagatgagattttagataagattattagaaaatataagaaattagcagaaaattgtgattttattgtttgtgaaaattctgattatgtcggggaaaattctgcctttgcttttgatattaatgtggccatcgccaaaacattagggtgttctttattaattttgggtaacggtcatcaaaaatctgtcaaagaaattagtgtttctcttaaaattgtggctgattcctatcgagaaaaacattgtaaaatcttaggcattattattaataaagttgcccattcagatattaattttttaaacaactatttacaacaaacctatagtaaaaataactatttattttcagttattccctatgataaaaagttaaatagtcccagaatgaaagaagtagcagaacagttaaaagccaaggttttatatggcgaaaaacgcttaaataatttggtgtttaattatctcattgctgccatgcaaatgcagcacgcaattactcaattagaggataatgatttagtggtaactccatcagatagaggggacgttattattggtgcattgcaagcgcatcaatcaatgaattacccgaatttagctggcatacttttgacaactgagtgtgaattagaaccgtcaattagtcgattaattgggggattaaatgatgccttacctatcctttgggttgatacttatacttatcctactgcttctcgattacaaacggtttatagttctttaaaagcaggggatattgaaaagattaattggagtattgaagtgtttgatcaatctgttaatcttgtcatgttagaacatctaattaataaaatagaagttgagggaataacgcctaagatgttcacttataatttaattcaaaaggcaaaattaaataaacgtcatattgttttaccagaaggaaaagatccccgtattctcaaagcagtggctacccttttatctcaagatatcgttgatattacagtattgggagaaaaaaaccgtatcgaacgaactatacaaagttatggtattcaattagatattaatagcctcaatattattaatcctttgaattctcctaagttagatgattatattacaaccttatatgcgcttagaaaacataaagggataaccctagaaaatgcaaaagatatgcttatggatgtgtcttattttgggacaatgatggtatattcaggggatgcagatggtatggtatcaggggcaattcataccacaggaaacaccataagacctgcattacaaatcattaaaactaaacctaaatatcagttagtttcctcggtcttttttatgtgtttacccgaaaaagttttagtgtacggagactgtgccattaatgccaatcctaccgcagaacaattagcagaaattgccattatttcggcggaaaccgctcaaactttcggcatttttcctagagttgctttgttatcttattcgtcaggagagtcaggaacaggagaagatgtcgaacgagtcaaacaagccaccatgttggctaaaaaacgccgtcaagaccttttatttgaagggccgatacagtatgatgctgcggtagataagaccgttgcagcacaaaaaatgccagattcggaagtggcgggacttgcaacagtgtttgtctttcctgacttaaatactggaaataacacttataaagctgtgcaaagagaaaccggagcgatcgccattggtccaattttacaagggttaaaaaaacccgttaatgatttaagtcggggttgtactgtagaagatattattaatacggtagttattacagccattcaagcaagtaataattaa

SEQ ID NO: 1588 - DNA, 2124 bp, Cyanothece sp. PCC 8802
atgactaattcactatacattgctacgacagaaggaaaaacaggtaaatccttaatttcactaggaattatggaactcctactcagaaaaaccacaaaagttggtttttttagacccattattcaagatcccatcgaccatcaacccgatcaacatctcaatttaattctctcccattttaaccttcctcaaaactatgaagagtcctatggattaccctattcagaagtgagtaacctcatgggacatcaaaaccttgatgaaattctagaaattattattactaaatacaaaaaactcgaagaaacctgtgattttatcctctgtgaaggatctgattatcttaaagaaagttctgcctttgaatttgatattaatgcaaaaattgctaaaaatttaggctgttctattttaatcctagggaatggttatcaaaaatctgtagaagaagcgatcgcccccattgaaattgctgtggatacctatcgagaaaaacaatgccccattattggaattatcatcaataaagccgatcaaagtcaatttaaactattaaaaaatgtcctagaaaaagattataaaaatactaactatttactctcaattatcccctacgacaaaaaattaggaagtcctagaataagagaaattgcccaacaattaaacgcgcaaattctttacggacgcgatcgcttagataaccttgtttttaattatctcgtcgcagcgatgcaaatgcaacacgcgatcagccaatttgatgaaaactgtctcgttgttaccccctcagaccgaggagacgtgattattgggacgctacaggcacatcaatccactaattaccccaatttagccggaatactgctaacaaccgaatatcaactggaacagtccatcgcgcagctaattagtgggctcaccgatcctttgcctattttgtgggttaatagttatacctatcctactgtatccgacctcaaagcagtctatagttcccttatccccgaagacaccgaaaaaatcgattggagtatcgatctttttgatcaatttgtgaacttaacgactctagaaaaacaaattagtacaatagaggtcaagggaataacccccaaaatgtttacctataacctcattcaacaagcgaagacccaaaaacgtcatattgttctccccgaaggaaacgaaccccgcatccttaaagcagccgaagttttactctccaaaaatattgttgatcttacccttttggggcaaaaaaaagaaattgaaagaatagttaaaactaataacatacaactagatattcagcaattaactattattaatcccatcgaatctgcaaaatttgatgactatgttcagaccttttatgacctcagaaaacataaaggggctaccctagaaactgcccacgactgcatcatggatgtgtcttattttggcacaatgatggtctataaaggagacgcagatgggatggtatcgggtgcaattcataccactagccacaccattcgacctgccttacaaattattaaaacacaacccgatatttctttagtttcctccgtcttttttatgtgtcttaatcacaatgtgttagtgtatggagattgtgccgttaatcctaaccccactgctgaagaattagccgaaattgccatcacttctgccgaaactgccaaaactttcgatattactccaaaagtcgctttattgtcctattcttcaggggagtctggacagggggaagaggtagaaaaagtcagaaaagcggcgcaaattgcccaaaaacgccgtcaagatttagccatcgaaggaccgatccaatatgatgcagcgattgatccccaagtcgctgcacaaaaaatgcctaattctagggtagcaggacaggctacggtgtttatttttcctgacttaaataccggaaataatacctataaagcggtacaaagggcaaccggggcgatcgcgatcggacccattcttcaagggttaaaaaaacctgttaatgacctcagtcgaggttgtacggtaggcgatattattaatacagtagttatcactgcaattcaatcacaaatccatctgacagggagaatggggaatgggcaatag

SEQ ID NO: 1589 - DNA, 2106 bp, Cyanothece sp. PCC 7424
atgactagctcactttatatcagtattacagaacctaatagcggtaaatctattatcacgttaggaattcttgaactaattctgcgtaaaacttttaaggtaggatttttccgtcccattattcaagaagagtcccaacggaaaaaagatagacatattgactgtctgattaatcattttcaactccctcaatcctatcaagaatcttatggagttacttatgctgaagtcaatcaattaatgggacaaaaaaaaatcgatgatattttagaaaaaattattgtaaaatataaaaaactagaacaaaaatgtgaatttatcctgtgcgaagggtcggattatttaggggaaagttcagcgtttgaatttgatttaaatatagaaattgctaaaaacttaggctgtccgattttaattttgggtaatgcctatcaaaatagtttagacgatgccctcgccccgattcaagtcgccgttaacgcttatcgagaacaacactgtcaaattgtcgggattattattaacaaagtcaccaaaagtttagttcaattattgaaaaaaaacctcgaacaagaatacaaagattcaggatatttattagcggttattccctatagtaaaagattagctagtccgcgagttcgagaagttgttgccctattacaggcacaagttttatatggacacagtcaactcgataacctcgtttttggttacttagtagcggcgatgcaaatgcaacacgctatcccccaatttagagtcaatgatttaattgtaaccccaagcgatcgcggagatataattattggggcaatacaagcccatcagtctactaattatcctaatttagccggtattgttctaactacagaatatcccctcgatacgtccatcagaactttaatagaaggtttaggggaaaccttacccattttgtgggtttcgagttatacctatgaaactgcatcccggttacaatcgatgaatagttcgatttctgcgggcgataaagaaaaaattaactggagtatagaactttttgaaaaatatgtagactggacagaattagagaaacaaattagcactatccgcgtccagggaatgactcccaaaaggtttacttataacttagtacaacaggctaaatggcagaaaaaacatattgtgttacctgaaggaaaagaaccccgaattttagccgctagtgctgttttattatctcgtgaaattgttgatataactttattaggtcgcccttcagatattgaaaaaaccattagaaataatgggattaatttagatatcaataatcttaaaattattaatcccgttgaaagtgagaactttgaatactacgcccaatccttatacgaagtcagaaaacataaaggcatgactttagatgcggctaaagatttattagcagatgtctcctattttggaacaatgatggtgtatcaaggggatgctgacgggatggtatcaggggcagttcataccacacagcatactatccgaccggccttacaaattattaaaacagaaccggattgttcgatcgtttcttcagtgttttttatgtgtttatccgatgaagttttggtctatggagactgcgccgttaatcctaacccgaatgcggaacaattagccgaaattgccattagttccgccctaaccgccaaaagattcggtattgaccctagaattgctttattatcttattcttcgggagaatcaggggttggggtagaagtggaaaaagttagacaagcgacgcaaatcgctaaacaacgtcgccctgatttaaaattagaagggccgatacaatatgatgccgccgtcgataaagcggtaggggcacaaaaaatgcccggttcagaggtggcaggacaggcaaatgtatttattttcccggatttaaacacaggaaataacacttataaagcggttcaaagagaaactggcgctattgctatcggccctattcttcaagggttgagaaaaccggttaatgatctcagtcgaggttgtacggtggaagatattattaatactgttgttatcaccgcgattcaagcacaaagtcttaactgtgattaa

SEQ ID NO: 1590 - DNA, 2097 bp, Microcystis aeruginosa NIES-843
atgactaactctttatatatcagcacgacggcaacgggaagcggtaaagcgttagtagctttaggaattattgacttaattctccgcaaaactaataaagttgcttttttccagccaattgttctcgactgttcccaaggtcatcgggacgaagacattgacttaatcctcaattattttaaattagaacaaacctacgaagaggcctttggtttatgttatgacgaagttaaggatttattggtacaacaaaaatttgatgaaatcatcgaaagaattatcaaaaagtttaaaaacttagaaaaaaaatatgattttatcctctgtgaaggttccgattacctgcaagaaaattccgcctttgaatttgaactaaatacagaaattgccaaaaatctcggccatcccatcttaatattaggtaatgcccacaatcgcagtatcgaagatgcccttagtccgatcctgatttcctgcgacacctaccaagataaaggttgtacggtgattgggattattatcaatcaagctgaagaggaaaaaataggggaattacggaaaaccctgactaaaatttttcccccccaagaatatgccctaggagtgattccccacaatgccaaactgagcagcccgcgagtggcagaaatcgcccaacaattacaggcaaaagttctctacggacagcagagattagacagtttagctagtaactttctggtggtggccatgcagatgcaaaatgccctagagcggataaaagaagatagtttaattatcactccttgggatcgcggcgatgtgattatcgggatgttacaggcccaccaatcagccaattatccccaattagccggtatagtcttaacagcaggtcataacctcaatccttcgatcgcccgtttaattgaaggtttgcccgatcccttaccgattctctccgtcaccaccgatacctacaccacggccgaacgcatccacgatgtgcggaccaccctaacctcgacggactacgataaaattaacctcagtctgcagctttttcacagtaacatcaatctcgatcgcctagaagcgcaaattcacactttgcggacccaggggattaccccgaagatgttcacctataatctcgtacaacaggccaaagcgcaaaaacgtcacatcgttttggccgaagggaccgaaccgcgcatcctccaggcggccacagttttaatcgaacaggatatcgtcgatttaacccttttgggacaaccggacgagatcgcaatggtgattaaaaaacatggtatcactctcgatctcgatcgcctgcaaattattgaccccgtggctagtccccattttgaaagctatgtgcagaccctctacgaagcgagaaaagccaagggaatgaatctcgacatggcccgggattatgcacaggatgtctcctattttggcactttaatggtgtatcaaggcgatgctgatggtatggtatcgggggcagtgcataccactcaacacacgattcggcctgcactccagattatcaaaactaagcccgattgtgcgatcgtctcctcggtcttttttatgtgtctagaggatcgggtcttggtctatggggattgtgcggtcaatcccgaccccagtgccgaggaattagccgaaatcgccctatcttctgccgaaaccgcccaaaaattcggaatagagccgcgaatcgccctgctttcctattcttcgggtcaatcgggccagggagaagacgtggaaaaagtacgacaagcgaccaaaatcgctagggaaaaacgccccgatttgaagctagaagggccgattcagtacgatgcggccgtggatagggaagtagccgcccaaaaaatgccggggtcagaggtagcgggccaagcaacggtgtttatttttcctgacctgaatacagggaataatacttataaagccgtgcagcgggaaacaaaagctttagcgattggtccaatcctacagggattaaaaaaacccgtcaatgatctcagtcgcggttgtaccgttcccgatattatcaatacggtggtaatcacggcaattcaatcccaatctttttga

SEQ ID NO: 1591 - DNA, 2097 bp, Cyanothece sp. PCC 7425
atgacccattcgctgtacatcagcacgacggaagcagggagtggcaaagccctcgcttctctgggaattatcgatttgattctacggcaaacaacccgagttcactttttcagacccgtcattcagaccaaaaacaagcgagatgaggacattgaactgatcttgacttactttggactgaaccagacctatgaagagtcctttggcttatcgtcccaggaagtcaatgaactgttgggacagcatcaggcgagtattgccctggaacaaattattgctaagttcaagcggttggagcagcggggcgattttattttgtgtgagggttctgattacctgggggaaggggctgcctttgaatttaacttgaatcaagagttcgcccgcaatctgggctgtccgattctgattttgggaagagctgataatcgtaccccagaggccaccctgcgtcccattcagatggcagtggatgcctatcgacagcacaattgtcaggtcatgggcatcgtgctcaatcgggccagccctgatcaagttgtcaccctcaaagccgcgctgaaaacccgctacggtgaggacggttacctgctagcggtcattccctccgatccccggttgggtagcccccgcgtgcgagatattgcggaccagctccaggcagaggtgctctacggccacacccatctggataatctggttccccattttctggtggccgcaatgcaaatgcagcacgccctgagctggctcaaggacaacagcctggtcattactcccggcgatcggggtgacatcattgtgggtatgttgcaggcccatcagtcaactaagtatccccaactggctggcttgctgctgtctaccggcctgaaacccgacccggcgatcgcaacgttaattgaaggcttacccgaccccctcccgatcctctccgtcaagactgatacctacacaaccgcttccctggtcaaagaggtccgcagttccctaattccagaggataaagaaaaaattagcttgagcatccgcgccttcgatgaccatgtggatttaagggagttcaagcagcagatcagcacgattcaggtccaggggatcacccccaagatgttcacctacaatctgctcaagcaggccagcacagaacctcgccacatcgtcctgccggagggaaccgatccgcgcattttgaaagccgctgcggtcctcacctcgcgaggaattgtcaagctaaccctgctggggcaacgggcgaaaattgaacaggtgattaagcagcagcggatcgagctggacctcaatgccctttcaatcctctacccgcctgagagcagtagactggagcactatgcccaaaccctgcatcaattacggcaacacaaggggattacgctggaagccgcccacgattatttgatggatgtctcttactttggcaccatgatggtgtatgaaggcgatgccgatgccatggtatcaggtgcagttcacacgactcagcacacggtccgacccgccctccaaatcatcaaagctaaaccagggttttcgatcgtttcctcagtctttctcatgtgtctagaagatcgggttctggtctacggggactgtgcagttaaccccaatccgacggcggcagaattggcggaaattgccatcacctcagctgatacggcccagtcctttgggattgaacccagagttgcattactctcttactcttccggcgactccgggcagggtgacgatgttgataaagtccgtcaggccactcaaattgcccaagcccgccgccccgatctgctgctggaaggcccgatgcaatacgatgctgccgtcaatccccaagtcgctgcccagaaacttcccggatcgatcgtcgcgggtcgagccactgtcctggtgtttccagatctaaatacaggcaacaatacctacaaggccgtccagcgggaaaccggggcgatcgcgatcgggccaattctgcaggggttgaagaagcctgtcaacgatctcagccggggatgcactgtggaagacgttatcaacactgtcgcaattacggccatccaggcccaaaccctctcctcctag

SEQ ID NO: 1592 - DNA, 2094 bp, Synechocystis sp. PCC 6803
atgacgagttccctttatttaagcaccaccgaagcccgcagcggtaaatctctagtagtattgggcattttagacttaattctcaaaaaaaccacccgtattgcctattttcgtcccattattcaagacccagttaatggcaaacatgataacaacattattctggtgctggaaaattttcgtctccaacaaacctataccgattcctttggtttgtatttccatgaagcggtgagtttagcctccgatggagctattgatcaggtattagaccgaattttggctaaatatcgccatttggcagatcaagtagattttattctctgtgaaggctcagactatttgggggaggaatcggcttttgaatttgatctcaacaccacgatcgccaagatgttgaactgccccattttgctgttgggcaatgccatgggcaacaccattgccgatagtttgcaacccatcgatatggccctgaatagctatgaccaagagtcttgtcaggtggtgggggtaatcattaaccgagtgcagcccgaattagccacagaaattcaagcccaactggaacagcgttatggcgatcgcccgatggtgttgggcactattccccaggacattatgctcaaaagtctgcgcctgagggaaattgtcagcgggctcaatgcccaagtactcagcggtgcggatttgctcgataacttggtctatcaccatttagtggtggcgatgcacattgcccacgccctccattggttgcacgaaaaaaataccctaattattacccctggcgatcggggcgacatcattctgggggtgatgcaggcccaccgctccctcaactatcccagcattgccggtattttgctcactgcagattaccatcccgaaccggccattatgaaactaattgaagggctacccgacgcccctcccctgttgctgactagcacccacacccatgaaacttccgcccgtttggaaactctccaccctgccctgagccctacggataattataaaattcgccacagtattgcgctgtttcaacaacaaattgatggggagaaattactcaattaccttaaaaccatccgcagtaaaggtattacccccaaactgtttctctacaatttagttcaagccgccaccgccgcccaacgacatattgtcctaccggaaggggaagaaattcgtattctcaaggcggccgctagcttaattaaccacggcattgtccgtttgactttactcggtaacattgaggcgatcgagcaaacggtaaaaattaatcacattgacttagatttgagcaaagttcgcctcattaatcctaaaactagcccagaccgagagcgctacgccgaaacctattaccagctacgtaaacataagggggtaaccctggccatggctcgggatatcctcaccgatatttcctattttggaacgatgatggtgcatttgggagaggccgatggcatggtttctggctccgtcaataccacccaacataccgtgcgtcctgctttacaaattattaaaacccagccaggtttttccttggtttcttcagtcttttttatgtgtttagaagaccgagttttggtctatggagattgtgctgttaatcccgatcccaatgcagaacagttagcagaaattgcccttacttctgcggctacggccaagaattttggcattgagcccagggtagctctattgtcctattcttccggttcttctgggcaaggggccgatgtggaaaaagtgcggcaagccacggcgatcgccaaggaaagagagccagatttagcattggaagggccgatccagtatgatgcggcggtggattccacagtggcggcccaaaaaatgcctgggtcagcggtggcgggtaaagcaacggtgtttatttttcccgatttaaataccggtaacaatacttacaaggcagtgcaaagagaaacaaaggcgatcgccattggccccattttacaaggattaaataaaccagttaatgatctaagtcggggttgtttagtggaggatattattaatacggtggtaattacagctttgcaagttaaataa

SEQ ID NO: 1593 - DNA, 2097 bp, Leeuwenhoekiella blandensis MED217
atgaataaaggaatttatatcgcgacgctcgagcctaatagtggtaaatctattgtttcgcttggtttgatgcgcacgcttttaggtaagacggccaaagtggggtatttcaggcccattattgacgatagtaaaaacaccggtaaagacaatcatataagtacggttctttctttttttgatatcaaactcgattatgaagatgcgtatgcgtttaccagcagcgagttgatcaaaaaacgtaataaagggaagtctggtgaaatactcgatacgatcattaccaagtataaaaatctagaagaccgttttgactttgttctggtagaaggatcagattttacaggagaaggaagtgtttttgagtttgacactaatgttctggtagcaaaaaatttaggcttaccggtaattcttgtaggaagtggtgtaaataaaaccgaagatgaacttctagggagtttgcaaattgcatatactacgtttttagagaaagatgtttcagttttggcggtggtggccaataaagttcaagaggaaaatttaatggttgctaaaaacggactgagcaatttcttacctgattctgttgaagtttttgcaattccttataccgaaaagctagcgcgacctacaatcaaagagattgtagaagagttagatggcgaagtcttatttggtgccgaatttctagacaatcaaaccgggaattttggagttggtgctatgcagctgcgtaattatttgacgcatttaaaacaagatagtctggtaattactccgggagatcgagctgatataattcttggagcgcttcaggcgaatatttcaaccaattacccgcgtatttccgggattatattaaccggagggttaaagcctgaagaaccaattttacaattaatacagggactttctcaaatcgtgccaattgtttcagtaaacgacggaactttttcggtgacgaatagagtagggaacatcaaatctcaaatttacgcaagcagcaaacctaagatcgaaacttcacttacagttttttctaaagaggtttcttttgataaacttattgagcgcctgatcaatttaaaacctaaaggaattacgccaagaatgtttcagtatggtttgatgaagcgcgcacgtacggctaaaaagcatatcgttatgcccgaagggacagacgaacgcatattgaccgctgcgattcagctcgtagaattagatattgttcaaattaccttgctgggcgaagtggagaaagtgaaagaaaaagctgtgcaactggggcttgccttagatttagataaaatctcggtgatcaaccccgtgcagtctgagcattttgatgattatgtagaaactttttatgaactgcgtaagcataaaaatgtaaatcgtgacattgcccgcgattggatggccgatgtttcatactatggcacgatgatgatctacaaaggccacgcagacggcatggtaagtggtgcggcgcatacgacgcagcatacgattagaccggcgcttcagtttattaaaacaaagcccggtgtttcagtggtgtcttcggtattttttatgtgtcttgaagatcgtgtttcagtatttggagattgtgcgatcaacccaaatccttcagctacagaactggcagaaatcgcgatttcttccgcagaaagtagtttggcctttggcattgagcctaagatcgcaatgctttcctattcctcaggaacttcaggaaaaggtgcagatgtcgatcgtgtacgtgaagcgaccgaaattgtcaaaaaagaacgtccagaccttaaaattgaaggtcctattcaatatgatgctgcggtagacgctgcagtaggaaaaagcaaattacccgattctgaagttgccggtcaggcgagtgttttgatctttccagatttgaatacaggaaataatacctataaagcggtacagcgtgaaaccggcgctctggccattggtcctatgctacaaggcttaaacaagccggtaaatgatttgagtcgcggttgtactaccgaagatgtttttaacacagtaatcatcacggcgatacaagcacaaggttttaattag

SEQ ID NO: 1594 - DNA, 2094 bp, Flavobacterium johnsoniae UW101
atgagtaaagcaatatatatagccactagtgattacaacagtggtaaatcaattatcacgctcggcttaatgagtatcttgattggtaaaacggctaaagtgggttattttaggcctataatcgaagattttgttgatggtgaggttgataatcatatcgaaaccgttttgtcttattttaaccttgatattgattttgaagatgcctatgcaattacaaaaagcaaattgatcaaaaagaaaaacaaaggaaaaataggcgaggttctggatcttattattgaaaaatacaaaaagctagaagaacgctttgattttgttttggttgaaggaacgagttttacaggcgaaggaacttcgatcgaattggatttaaatgttttaattgctaagaatctgggaattccaaccataattgtaggttcaggagttggtaaaactttagaagaacttttagacagtttgtacttagtttatgattctttcaaagtaaaagaagtagaagtcctgtcagtttttgcaaataaagtacagccggaaaatattgaattggttacaaaaagtctgcagaagactttaccttcaaatgttttaatcaatacaattccgcttatttcgagtttgaataacccaaccatgcaggaaattgtaaacgaattgaacgccaaagttttgtttggagaaaactatctgaataatgaaattggacattacagcgttggagcgatgcagcttcataattatctggttcatttacacgataatgctctcgtgattactccgggagaccgttctgatattattttaggagctttacaagccaatgaatcggctaattatcccactatttcgggaattatcttaaccggcaatattgttcctgaggaaagcattttaaaactcattgaaggactttctgcaattgttcctattattgctgttgatggcggtacttatcatattacaaataaaataggatcgattaaatctgagatttatgccaacaacacgcataaaattgaaacctcaataactacttttgagaaatacgttaataacgacgctttatctgaaagattaatcactttccaggcagaaggcatgacgccgaaaatgtttcaatacaacatggttaaaagggctaaacagcacagaaaacatattgttctgccagaaggaaatgatgacaggattattactgcagcatcaagattattagatatggatgtggtcgatatttcgattattggagataaaaaacaaattgaaaacaaagtggtagaactaggcatcactttagatttttcaaaagtaaacatcatcaacccaatagaatctgaaatgtatgaagattatgctaatacttattacgaacttagaaaagctaaaaacgtaagtattacaatggcaagggatttaatggaagacgtttcgtattttggaaccatgatggtgtacaaaggccatgcagacggaatggtttcgggtgcagcacatacaacgcagcataccattttaccggcattgcaattcattaaaaccaaaccaaattcatccgtagtttcttctgtattttttatgtgtttagaagaccgtgtttctgtttttggagattgtgccatcaatccaaacccaactgcagaacaattggcagaaatcgctatttcttctgcagaatcaagtttggcattcggaattgaaccaaaaatagctatgctttcatattcttcgggatcatcaggaaaaggagatgaggtagacaaagtaagaactgctacagcaattgtaaaagaaaaaagaccagatttaaaaattgaaggtccaattcagtacgatgcagcagttgatttaagtgttggaaaaagtaaaatgccggattcagaagtggcaggacaagcaagcgtattgattttccctgatttaaataccggaaacaatacctacaaagctgttcaaagagaaaccggagctttagcaattggaccaatgttacaaggcttgaataaacctgtaaacgatttaagccgcggctgtacggttgatgatattattaatacagtcgtaattacagcaattcaggcacagggaatgtaa

SEQ ID NO: 1595 - DNA, 2097 bp, Robiginitalea biformata HTCC2501
atgaacaaaggcatttacgtggccactatcgaggccaacagcggaaaatccatcctctccctggggttgatgcggctcttgctggggaaaatggcacgggtagggtatttccgcccgattatcgatgactatcccgacggcaaacaggacaaccatatagccaccatcctgtcgcatttcaacattcccctcaattatgaggaagcctatgcatgcacgcgcagccaggtggtccaaaaaaccagcaggaaccgggaagacgaggtactcgacacgatcattcagaaatacaaggacctggaaagccgttttgactttatcctcgtggaggggacggattttacgggggagggggccatcatcgaatgggatttcaacgtactcctggctaaaaacctggggatcccgacggtcatcctgtctacgggcgtgggtaaaaccctggaggaatttgtcaattccctggcactggcctgcgactccttccgcgataagggagttgaggtcctcatggttgcggccaataaaatccagccggagaaccggcagctcgtcctggatcagatgcactccgacctgccggagggggtgttgacggcggccatacctctgaacccggtactcggcaacccgagtatgcgcgaaatagcagacgccctgggcggagaggtcctgttcggagcgcggcacctggacaaacaggtagcgcattttggggtgggggccatgcaactcaggaattacctgacgcacctggtggaagccaccctggtaattaccccgggggaccgcgccgatatcatcctcggggccctgcaggccaacctgtcgacgaactacccgtccatttcggggatcatcctcaccggcgggcttgtaccggaggaaacgattatccgcctgatcgaagggttgtcggaagtggtgcccatcgtttcggtccaggggggcaccttttcggtcaccaaccggatcgggtctatccagccccggatttacgccgggaataccctgaaaatcgaacaatccctcaaggacttttcggcctatgtgccagaagacgcattggcggagcggttggtcaccttccgggctgagggcatcaccccgcggatgttccagtacaacttgctcaaaaaagcccagtcggacgtaaaacacatcgtgttgccggagggtgcggaccagcgggtcctccgggctgccgtggaactggccaggtatcaggccgtccgcctcaccctgctggggcggcctgaagagatccgggagaaggcccggcagctccagctggaacttcccggggagatccaacttctggacccccggaatgccccgcagtttgaggagtatgccaacacgctgtatgagctgcgaaagcacaagaacatggaactgaccatggcacaggacctgatgtccgatgtgtcctatttcggcacaatgatggtccataagggacacgccgacggcatggtgtccggggcggcccataccacccagcacaccatccgtcccgccctgcagtttatcaggacacgacccggggtgcacctggtttcctccgtattttttatgtgcctcccagaccgggtaaccgttttcggcgactgcgccatcaacccgaacccggacgcggcggagctcgccgaaatcgccatttcctccgcggataccacagcctccttcgggattgaaccccgggtagccatgctgtcctattcctcggggagttccggccagggcgccgatgtggaccgggtgcgggaagccacgcgcctggtgcgggaacgcaggcccgacctgaaggtggagggcccgatccagtacgatgccgccgtagacctgaaagtgggacgcagcaaactgcccgactccgaggttgccgggcgggcaacggtttttatatttccggacctgaacaccgggaacaatacctacaaggctgtgcagcgggaaacgggcgcgctggccatcggcccggtcctgcagggcctgaacaagccggtaaacgacctgagccgcggctgtaccgaggacgatatcttcaatactgttgtcattaccgccatccaggcccagcaaatccgaaaatga

SEQ ID NO: 1596 - DNA, 2097 bp, Flavobacteriales bacterium HTCC2170
atgagcaaagccatttatattgccacaacagaacctaacagtggcaaatcaataatttctctgggtctaatgcaaatgttattgggaaaagcagctaaagtcggctattttagacctattatcgatgactacacgaatggtacaaaagataaccacataaaaaccattatttcctattttaatttgccaattgcctatgaagacgcgttcgcatttacacgcagcgaggttattcagatgaataatcagaataaagaagatgaggttcttgataagattatagaaaaatataagagcatagaagatcagtttgattttgtgctggttgaaggcacggacttttctggagaaggagcgatcattgaatgggatatcaatgtacttatggcaaagaacctgggtattccaacactcatattgacaagtggtgttggtaaaacattggatgagttggtaaataatgtctacttggcctatgattcatttaaggatcatggtgttgaggttcttatggttgttgccaataaggttcaagagaaaaatttagagctggtaaatgagagtttgcaaaaagttatacctgaagaggtattggtagggtcaataccaatgaatcctgttttgggcaaccctaccataaaagaaattgttgatgttcttgaaggtaaagttctctttggtgaaaaatatttaaataatcaagcagggcattttggcgtaggggccatgcaattacgcaattacctcacccatttaaagaaagatggacttgtaattactcctggtgatagggccgatattattcttggagccttacaagcaaatttatctgctaattaccctactgtatctgggatgattttaaccgggggaataattcctgaagaacctattgccaagcttattgaggggctttcagacgttgtgcccataatttctgtagaagaaggaactttttcaataacaaatcgaattggggcgatcagaccgaagatatatgcggagaacactcataaaataatgacctcaattcaggacttttcaaaatatatacctgaggaagtgctggccaagagattgataacatcgaagtctaaaggaattacacctagaatgtttcaatataatttactgaagcgggcaaaagcagataaaaaaagaattgtacttgcagaaggattggatgaacgtgtattaaaggcaacaaagcaattgctagatgccaatgccgttgaaatcaccttactaggtgacccaatacaaatagcagacaaaatatcactgatggatttagatcttgatcttaatagtattgagatagagaacccaactgaatctaaatattttgatgaattctccgaaaccctatatgaattgagaaagcataaaaatgtgaatttggcaatggcccgtgatcttatggaagatgtttcatattttgctaccatgatggttcataaaggttatgcagatggcatggtatcgggtgcaatacatactacaaaacacaccattcttcctgcattacattttataaaaacacgaccagatgtttctgtggtttcttcagtcttttttatgtgtcttgaagatagggttacactctatggtgattgtgccataaacccgaacccagatgcagaacaattatcagagattgccatatcttcagctgaaacaagtcaagcatttggtattgacccaaaaatcgcaatgttatcatactcctcaggtagttcaggagtgggcgaagatgttgagagagtacgtaatgcaaccaaattggtaaaagagaaacgacctgatctaaaggttgaggggccaatacaatatgacgcagctgttgatataaatgtgggcaaaaccaaaatgccagggtcacaagtggccggtgaggcatcagtttttatttttccagatcttaacacagggaacaatacctacaaagccgttcaaagggagacgggaacgatagcaatcggtcccattttacaagggcttaacaaacctgtgaatgacctaagccgaggttgtaatgtggacgatatctttaacgctgtgattattactgcaattcaggcacaagatttagaataa

SEQ ID NO: 1597 - DNA, 2094 bp, Polaribacter sp. MED152
atgagtaaagcaatttacgttacaaccatagaaccaaatagtggtaaatctttaatatcacttggcgttttaagaatgatgctgactaaatctacaaaagtgggctatttcagaccaattatcaacaaaagcaaaaccgatagttttgataaccacacaaacacggctattaacttttttaatttagacctagactacaatgattgccatgtttacgagcaaagtgaagttgtagagttgttaagcgaaggaaaagaagatgaaataattcataaaataattggcaaatacaaaagcttagaacaaagattcgattacgttttagtagaaggaacagatttttcaggtgaaggtggttttactgaaattgacgtgaatttaatggttgccaaaaatttaggaattcctgttttaattgttggtgcaggaaatggtaaaaagaaaaaggattttatcaatacaatgcaattaacctacaactcttttattcagaaagaagtggatgttattggtttaattgcgaataaaacagaaactgacgaaattgagtatgtaaaagatcaactagcaaaatcaattgcaggagacatacaaatagatgtaattccgaaagtagattttttagcttatccaacagtaaaagaagttgtagaagaattagagggtaaagttttatttggagaacaatttttagataatgctattggaagtttcagtactggagcaatgcaactaagaaattaccttactcacattaaaaacaatgcacttgttataactcctggagatagagcagatattatcttaggtgctttacaagcaaatgcatctagcaattaccctaatatttctggaatcattttaactggtggcttaattcctgaagattcaattatcaagttgattgaaggagtacaatctaccattccaattatttctgtaaaaggaggcacatttggcatatcaaacaaaataggtgctgtaaaacctaaaatttatgcaactaacagaaaaaagattttattagctttagacacttttgatgcgcatgtaaacgcaacaggattaacaaatacgctttctaattttaattctgaaagattaacgccaagcatgtttcaatacaatttactgcaaagcgcaagagcacataaaaagcatattgtattgccagaaggaaatgacgaaagaattattagagctgcagctagattacaacttttaaatattgttgatttaactttattaggagataaaagagaaattcaggccaagtgtaatcaattaggaattcagattgatctcgaacaaattcaagttttaaaccctgaagattccattcataatgatgcttttggcaaaacactttatgaggctagaaagcataaaggaatgacagaaaccacagcaaaagatttaacaagagatgtatcttattttggaacacttatgattctaaatggtttagctgatggtatggtttctggagctgtacacacaactatgcacactataaaacctgccttacaaatcataaaaaccaaacctggtgtttctgtagtttcttcagtattttttatgtgtttgtcagatagagtttctgttatgggtgattgtgctgtaaatccaaatccgaatgcagaacaattagcagaaattgcaatttcatctgcacaatctgcagaagcctttggtatagaagcaaaagtggcaatgttatcctattcatcaggaagctctggaaaaggtgaagaagtagaaaaagttagaaaagctactgatattgtaaaaacaaaagaaccaagtttaaagatagaaggtccaatacaatatgatgcagctgtagacatgtctgttgcaaaaactaaaatgccagattcagctgttgctgggcaagcatctgtattaattttccctgatttaaatactggtaataatacttacaaagctattcaaagggaaactggagctttagcaattggccctatgttacaaggtttgaataagcccgtaaacgatttaagtagaggctgtactgtagatgatattttcaatactgttttattaaccgctattcaagcagaacaaggataa

SEQ ID NO: 1598 - DNA, 2091 bp, Polaribacter irgensii 23-P
atgaataaagctatttatatcgctaccgtagaatctgacagtggtaaatctttgatatccctcggtctgttgcgcgtaatgttaacaaaatccgctaaagtcggttactttagaccgattatcaatgaatttgacagtgacggttatgatgaacataccaaaacagctattaatttctttaatttagacatcgattataaggattcttttgcttacaagcaaagtgaggtggtttctcttttaagtgcaggaaaaggagctgaaatgattcataatgtcattgaaaaatataaaaagatcgaggccaactatgattacgtattagttgaaggtaccgatttctctggtgaagtaggttttaccgaattagatgtgaatctaatgattgctaaaaacttaaacattccagcattaattgtaggttctggaaacggaaagaaaaagaaggattttataaatacgatgcaacttacctacaactctttcattcataaagaggtggatgttcttggaatcattgccaacaaaattgaagaagacgaagtagactatattcgtgaagaactcactaaaaattttcccgaaaagctacagatagacatcattccaaaaatagatttcttagcatttccaactgtaaaagaagtcgtagaaacattgaacggacgtgttttatttggagctcaatttttagacaacgctattggtagctatagcacgggcgcaatgcaattgagaaattacttaacgcgtattaaagaaaatgcgttggtcattacaccaggagacagagcagatattattttaggtgctttgcaggcaaatgcctctaaaaattatcctaaaattgcaggaattattttaaccggtagcatcattccagaagcgcctatcctaaaattaatagaaggagtacaatccacagttcctattatttccgttgacggtggcacttttagtgtttccaataaaattggtgctgtacaatccaaaatctattcaacacacaataaaaaaatattattgtcactcgatacttttgacaaatatgtaaatgcagaaggtctagcaaatattctgacctcctatcggtcacagaaattaacccccagtatgtttcaatataatttattgcaaaaagcacgaattgttaaaaaacacattgtattaccagaaggcgacgatgaacgtattttgaaagctgcagcacgtctacaattactagatattgttgatttaacgctgttaggtgaccgcaatacaattcagttaaaatgcgatcaaattggtctacaaattgacttaaatgcgctaaacattctaaatcctgagaattccattcacaacaaagattttgcaaccacactttttgaagcaagaaagcacaaaggaatgtccgaaacaactgcgatggatttagtgcatgatgtttcctacttcggaacgctaatgattctgaaaggtttggctgacggaatggtttctggagcagttcacacgaccatgcataccataaagcctgccttgcaattgataaaaacaaaaccaggagttacggtggtatcctctgtattttttatgtgtttgtcggatagagtttcggtaatgggagactgtgccgtaaatccaaatccaaatgcagagcaactttctgaaattgctatttcctccgccgcctccgctgaagctttcggaattgaagcaaaagttgcgatgctctcttattcttccggaagttcaggaaaaggggaagaggtagaaaaggtaagaaaagcaacgaccttggccaaagaaaaaaatccaaatttaaaaattgagggacccatacaatacgatgcggcagtagaccgatcagttgcaaaaacaaagatgccagattcagaagttgcaggacaagcttccgtattgatttttcccgatttaaacacaggaaacaatacgtacaaagcaatccaacgggaaactggggcactggccattggtccgatgttacaaggtttaaataaacctgtaaatgacttaagtagaggctgtactgttgatgatatttttaatactgttctgttaactgctattcaagcaaatcaataa

SEQ ID NO: 1599 - DNA, 2076 bp, Capnocytophaga sputigena ATCC 33612
atgaataaatctgtttatgtcattgctgcaaatacccatagtggtaagtcagtagtgagtttgggagtcttgcaaatgattatgtgcaacactgccaaggtaggttattttagacctattgtagaaagtaaatctaaaaaagatactttcatcgaaactgttttagaacattttaaactcgatatgagttatgatgaagcctatgcctacacacgtcaagaggttatcgctcttaaaaacgaaggtaatataggcgaagtgtatgatactatcatcaaaaaatacaaagccttagaaagtaagtttgactttgtattagtcgatagttcaagtgccgtagacgatagctatttcgatgcaaacttcaacgcttcagtagctcaaagtctaaacattcctgcattggtagtacttaaagacaattttgcttcagaagatgaactcgctaaccaagtacaagctaccctaaacaattttatagaaaaagatgttcgcgtactcagcgtgtttgtaaacaaagctactaatgctactgctgctactatcaactgtttagaacagcgcttcagcgatactacttttaccgttattccgcgcaaagaagaactctctcgccctaccattcgcgagattgctaacgctctcaatgccgaattcctttataaaggtgataatattgatgttactaccaaacgaactatcgtaggagctatgcaattatctaactatttagccaagctaaacgaagatactttagcagtactccccatcgaccgtatcgacctcatagctggatctttagtagctaactattctaacttctctaatattaaaggagtagtactctatggtgatttaacactcaatgcttctatgagtaagattttcgatggtatccaaaagaatatccctataatggtagctaaaaccgatactttcgaaactgctaatatcatcggtaatacccaagcacatatctaccctgaaaatactgaaaaagtaaaaatgttacttcagttatttgatgaaaatgtagatgctgaaaaactcaacaatagtattgcttctttcaaatcagaaactattacccctcgtatgttccaatacaatatggtacaaaaagctcgtgcaggacaaaaacatattgtattaccagagggtactgacgatcgtattcttactgcagcctcacaattggctgaagacgaactcgtttacctcactatcttaggagaacccgaagctattaaaacacgcgctaagaacattttgggcttgaaatggaatgaggatcgtatcaacatcatcaatcctgctgagagtgaaaaatacgaagcgtatgctgaaaaactatacgagttgcgcaaaagcaaaggattggagctttcgcaagctaaagatttaatgctcgatgcttcttattttggtacaatgatggtattcctcggtgatgccgatggtatggtatcaggagctgtaaatacaaccgctcacactatccgtccatctttacaattcgtaaaaactaaaccaggagtaaacacagtgtcatcagtattctttatgttgttgcacgaccgcgtattggtatatggagactgtgctgtagtgccaaaccctactgctgaacagttggctgacatagctatcagctctgccgactctgctattgcctttggtattgaacctaaagtagctctcctctcctactcttctggtaactcaggtagtggtgccgatgttgataaagtgcgtgaagcaactgcacttgtaaaagaacgtcgtcctgaactactcgtagaaggacctatacaatatgacgctgcggtagaccctaaagtaggtaaacaaaagatgccaaattcacctgtggcaggacaagctaatgtacttatcttccctgatcttaacaccggtaataacacctataaagcagtacaacgcgaaacaggtggtctggctataggacctatgttacaaggattgaaaaaacctgtaaacgacctcagtcgtggcgctcttattcctgatatctacaacactgtacttatcacagcaatacaatcagaattttag

SEQ ID NO: 1600 - DNA, 2076 bp, Capnocytophaga ochracea DSM 7271
atgaataaatctgtttatatcatcgctaccaatgcacacagcggtaagtcggtggtgagtttgggtgtgttgcaaatgattatgcgcaacactgctaaggtaggttattttagacctattgtagaaagtaaatctaaaaaagacactttcatcgagactgtcttggagcactttcagctcgatatgagttacgatgaagcctatgcctacacacgtcaggaggttatcgctcttaaaaacgaaggcaatataggggaagtatatgacactatcatcaaaaaatataaagccttagaaagcaaattcgactttgttttagtggatagttcaagtactatagacgatagctatttcgacacaaacttcaacgcttcggtagcacaaagtctcaacattcctgctttgatagtgcttaaagacaacttttcatcagaagttgaattggtgaaccaagtacaggaagatcttaacaacttcttggaaaaagatttgcgcgtacttagcgtatttgtaaataaggctaccaatgctactgctgatacgctcagcaaattagaacaacgctttaaagatataaccttcactttgattccgcgcaaagaagagctttcacgccctactatccgcgagatagccaatgcactcaacgttgaattcctttacaaaggcgataatatagacgttaccaccaaacgtaccattgtgggagctatgcaactttctaactatttagccaaactaaacgaagatactttggctgtactccctactgaccgtattgacctcatagcaggttctttggtggctaactattccaatttctctaatatcaaaggggtagtactatacggcgacttaacccccgacccttcaatgagtaaaattttagatggtatccaaaagaacattcctataatgatagctaaaacagatacttttgaaactgctaatatcattgggaatacaaaatcaagcatctatcctgaaaatactgaaaaggtaaaaatgcttcttcaactatttgatgaaaatgtagatgctgcgaaactcaacagcagtatagcctctttcaaatcggaaactattacccctcgtatgtttcaatacaatatggtacaaaaagcacgtgcaggacaaaaacgcattgtgttaccagaaggtactgacgaccgtattcttactgcggcttctcaattggcagaggacgaactcgtttacctcactatcttgggagaaccggaagcaattaaaacacgagctaagaacattttgggcttgaaatggaacgaagagcgtatcagtattatcaatcccgctgaaagtgataaatatgaggcgtatgctgaaaaactatacgaattgcgcaagagcaaaggattggagctttcgcaagccaaagacttaatgcttgatgcgtcttatttcggtacaatgatggtattcttaggcgatgctgatggtatggtatcaggagcagtaaacactacagcccacactatccgtccgtctttgcaatttgtaaagacaaaaccaggggtgaacacggtatcatcagtattctttatgctcttgcacgaccgcgtactagtatatggtgactgcgccgtagtgcctaaccccactgctgaacaattagccgatatcgctattagctctgccgactcagctattgcttttggtattgaacctaaggtagcactcctctcctactcttctggtaattctggtagtggtgccgatgtagacaaagtgcgtgaagcaacagcacttgtaaaagagcgtcgccccgagttactcgtagaaggacctatacaatatgacgctgcggtagacccaaaagtagggaaacaaaagatgccaaattcacctgtagcaggacaagccaatgtgcttattttccccgaccttaacaccggtaataacacctataaggcggtgcaacgcgaaacaggcggtttagccataggtcctatgctacaaggattaaagaaacccgtaaacgacctcagtcgtggggctcttatcccggatatttacaacactgtacttatcactgcgatacaatcagagttttag

SEQ ID NO: 1601 - DNA, 2115 bp, Desulfovibrio vulgaris str. Hildenborough
atgtccaacaatctgtacatcaccgcgacagagtcgaagagcggcaagtccgcggtggtgctaggcatgatgcaactgctgctgcgcgacgtccgcaaggtggccttcttcaggcccatcatcaatcaggcgtccaccgacgtccgcgaccacgacatcaatctcatcctgcgtcacttcgggctcgacatcgcctacgaggacacctacgcgtactcgctgcaggacgcccgcgaactgatcaacaacggtcagcacgccacccttctggacaacatcctcaagaagtacaagaagctcgaagacgcctacgatttcgtgctctgcgagggcaccgactttctcggcaaggatgccgcgttcgagttcgaactcaacgccgacatcgccgccaacctcggctgccccgtcatggtggtggccaacggccagcagaaggccgcccgtgagctcatcgcctcgacgcagctgaccatcgaccttctcgacgagaagggcctcgacgtggtcacggcggtcatcaaccgcgccaccgtcaccgaagccgagcgcgaagagatcatcaagagcctcgagtgcaaggtcaactgctcgaacccgctcgccgtgtacgtgctccccgaagagtccaccctcggcaagcccaccatgaacgacgtcaagaagtggctcggcgcacaggtgctctacgggcacggtcgcctcgacacgctggtggacgactacatcatcgccgccatgcagatcggcaacttcctcgactacgtctcgcagggctgcctcgtcatcactcccggcgaccgttccgacatcatcctctcgagcctcgcctcgcgtctttccacggcctatcccgacatctcgggcctgctgctcaccggcggcctcgagcccgcagccaacgtccatcgcctcatcgaaggctggacgggcgtgcccatccccatcctgtcggtgaaggaccacacctacaagaccatccagacgctgaacgaactgtacggcaagatcgagccggacaacgaccgcaagatcaacacggccctcgccctgttcgagcgtcatatcgacagcagcgaactcggctcgcgcctgatcaaccgcaagtccagccgcatcacgcccaagatgttcgaattcaacctcatcgagaaggccaagcgcaaccgtatgcgcatcgtccttcccgaaggggccgaagagcgcatcctgcgtgccgccgacatcctcgtgcgccgcgaagtggccgacatcatcctgctgggcgatgccaacaccgtaggctcgcgcatcggcgacctcggcctcgacatggacggcgtgcagattgtccagccgaacctctcgcccaagttcgacgagtacgtcgcagcctaccacgagtgccgcaagaagaagggcatcagcatggagcaggcgcgcgacatgatgaacgaccccacctacttcggcactatgatggtgcacaagggcgatgccgacggcatggtctccggcgccatcaacaccaccgcacacaccatccgcccggccttcgagttcatcaagaccaagcccggcgtgtccatcgtgtcgagcgtgttcctgatgtgcctcaaggaccgcgtgctggtcttcggcgactgcgcagtgaaccccaaccccactgccgaacagctggccgaaatcgccatcagcgcctcgcacaccgcccgtatcttcggcgtcgacccgcgcgtggccatgctctcgtactccaccggcagttccggcaagggtgccgacgtggagaaggtcatcgaggccacccgcatcgccaaggagcgcgcccccgaactgctgctggaaggcccgctgcagtacgacgccgccatcgacatggatgtggcacgcaccaagctgcccggcagcactgtcgccggtcaggccaccgtgttcatcttccccgacctgaacaccggcaacaacacctacaaggcggtgcagcgcgccgccggtgccgtggccatcggcccggtgctccagggcctcaacaagcccgtcaacgacctctcccgcggctgcacggtggctgacatcgtgaacaccgtcgcgatcacggccatacaggcccaggccgaaaagggcctgatctaa

SEQ ID NO: 1602 - DNA, 2115 bp, Desulfovibrio vulgaris str. 'Miyazaki F'
atggccaacaatctgtacatcaccgcgacggaatcgaagagcggcaagtccgccgtggtgctcggcatgatgcagctattgctgcgcgacatccgcaaggttgccttcttccgccccatcatcaaccggcctgtcacggacgcggtggaccacgacaccaacctcatcctgacccacttcaacctcgacattcccgtggccgacacctacgcgtactcgctgcaggacgcccgggagctgatcaacaacggtcagcacgccacgctgcttgaaaacatcctcaagaagtacaagcagctggaagacagctacgacttcgtgctctgcgagggcaccgactttctgggcaaggatgccgccttcgagttcgacctgaacgccgacatcgccgccaacctgggctgccccgtgatggtggtggccaacggccagcagaagaccgcccacgaaatcgtcgcctccacccagctgaccatcgacctgctggacgaaaagggactggatatcgtggccgccgtgatcaaccgcgcttcggtcaccgatgccgaacgcgacgtggtgatcagcagccttgaatgcaaggtcaactgctccaacccgctggccgtgtacgtggtgcccgaggaacccaccctgggcaagcccaccatgggcgacgtgaagaagtggctgaacgcccaggtgctgtacggccacggccgcatggacaccctggtggacgactacgtcatcgccgccatgcagatcggcaacttcctcgactacgtcacccccgggtgcctcgttataacccccggcgaccgttcggacatcatcctcaccggccttgccacccgcctttccggcgcctaccccgacatttcgggcatgctgctgaccggcggcatccagcccgcgcccaacgtgcaccgcctcatcgaaggctggaccggggtgcccattcccatcctgtcggtgaaggaccacacctacaagaccatccagaccctgaacgaactgtacggcaagatcgagccggacaacgagcgcaagatcaacaccgccctcggcctgttcgagcgttccgtggacagccaggaactgggccgccgcctgatcaaccgcaagtccagccgcatcactcccatgatgttcgagttcaacctgatcgaacgcgccaagcagaaccgcatgcgcatcgtgctgcccgaaggggtggaggaacgcatcctgcgcgccgccgacatcctggcccggcgcgaggttgccgacatcatcctgctgggcgacgccgacaaggtgggcgccaaggtcagcgaactgggcatcgccctggacggcgtgcagatcatccagcccaacctgtcgcccaagttcgaggaatacgcccaggcctacttcgaactgcgcaagcacaagggcgtcagcatcgaacgcgcccgcgacaccatgaacgacgtcacctacttcggcaccatgatggtgcacaagggcgacgcggaaggcatggtttccggctccatcaacaccacggcgcacaccatccgcccggcgttcgagttcatcaagaccaagcccggcttctccatcgtgtccagcgtgttcctgatgtgcctgaaggaccgcgtgctggccttcggcgactgcgcggtgaaccccaaccccacggcggaacagctggcggaaatcgccatcaactcggcccacaccgcgcgcatcttcggcatcgagccgcgcgtggccatgctgtcgtactccaccggctcgtccggcaagggcgccgacgtggaaaaggtcatcgaggccacccgcatcgccaaggaacgcgcgccggaactcctgctggaaggtccgttgcagtacgacgcggccatcgacatggatgttgcgcgcaccaagctgcccggcagccaagtggccggccaggccacggtgttcatcttccccgacctgaacaccggcaacaacacctacaaggccgtgcagcgcgccgccggggccgtggccatcggcccggtgctgcagggcctgaacaagcccgtcaacgacctgtcgcgcgggtgcacggtgcccgacatcgtgaacaccgtggccatcacggccattcaggcgcaggccgaaaagggcctcatctag

SEQ ID NO: 1603 - DNA, 2160 bp, Desulfovibrio desulfuricans subsp. desulfuricans str. G20
atgcccgacccggggcagatgaaatggatatgcaaggagtccaacgtgtccaaaaacctgtacatcacagcgacggagtccaaaagcggcaagtccgccatcgtgctgggaatgatgcagctattgcttcgcgatgtccgcaaagtcgcgtttttccgccccatcatcaacaacaccagcaaggaagtccgcgaccacgacatcaatctgattctgacgcgtttcggtctggatattccctacgaaaagacctacgcctactcgcttcacgaagccagagagctgatcaacaacgggcagcacgccaccctgcttgagaacattctcaacaagtataaagcccttgaagcagagtacgatttcgtactgtgcgaaggcaccgactttctgggcaaagacgcggcattcgagtttgacctgaatgccgacatcgccgccaacctcggctgccctgtgctggtggtggccaacggtctggacaaaaacagcgaggaaatcatcggctccacccagctgaccatcgaccagctggacgaaaagagccttgacgtggtggccgccgtggtcaaccgcgccagcgttacccccgctgaaaaagacaacatcatcaaaagccttgagtgcaaggtgaactgcgccaacccgctggccgtgtacgtggtgcccgaagagcccaccctcggcaaacccaccatgggcgacgtgaaaaagtggctgggagcctctgtgctgtacggccacggccgccttgacacgctggttgacgactacatcattgcggccatgcaggtgggcaacttcctggattatctgggacagggcaccctcatcatcactcccggcgaccggtccgacatcattctggccagccttgcctcgcgcctgtcttcctcctaccccgacatttccggcattctgctgaccggcgggctggagcctgcggccaatgtgcaccgccttatcgaaggctggaccggtgtgcccgtgcccgtgctgtgcgcaaaggaacacacctacctgaccacgcagatactcaacgatctgtacggcaagatagaccccgaagacgaccgcaagatagccacggctctcggcgtgtttgaacagaacgtggacaccgccgaaataagcaaccgcatcatcagccgccgctcttcgcgcattacgcccaaaatgttcgagtacaatctcatcgaacaggccaaaaaacacaaaatgcgcatcgtgctgcccgaaggggccgaagaacgcattctgcgtgcagccgacattcttgtgcgccgcggcgtggcagacctgattctgctgggcaatgccgacgaagtaggcaaaaaaatcggcgatctgggactggaccttgacggcgtgaccatcatccagcctgaacttgcacccaacttcgaagactatgtgcagacgtactacgaagcccgcaagaaaaaaggcatcagcatggaacaggcccgcgacatcatgtccgaccccacctactacggtaccatgatggtgcataaaaacgacgcagacggcatggtttccggtgccatcaacaccaccgcgcacaccatccgccccgcgtttgaattcatcaagaccaagcccacggcttccatcgtatccagcgtgttcctcatgtgcctcaaagacagagtgcacgtgttcggcgactgcgcggtcaaccccaacccgtctgccgaacagctggccgagattgctctcaactcttcggatacggcacgcattttcggcatcgagcccaaggttgccatgctctcttactccaccggttcttccggcaagggtgcagatgtggaaaaggtcatcgaagccacccgcatcgccaaagagcgcgcaccggaacttgcacttgaagggcctttgcagtacgacgccgccatcgacgccgatgtggcccgcaccaaaatgcccgacagcaatgtggcaggtcaggccaccgtgttcatcttccccgacctgaacaccggcaacaacacctacaaggcggttcagcgcgccgcaggcgccgtggccatcggccccgtgctgcagggcctgaacaaacccgtcaacgacctgtcccgcggttgtctggtgcctgacatcgtcaacaccgtcgccatcaccgccattcaggctcaggcggaaaaaggccttcgctag

SEQ ID NO: 1604 - DNA, 2118 bp, Desulfovibrio salexigens DSM 2638
gtgtctaaaaacctttacatcacagccaccgaagagaagagcggtaaatctgccattgctctcggcgtgatgcaactgttgctgagagacctgcagcatgtcgccatcttccgtcctatcattaatgataaccagacaggctcccgcgatcacgatatcaatctgatcatggaatacttcaatctggatatcagttatgaagacacctatgcctacactctgaaggaagcacgtgaactcatcaacagcggcaaacactctctgctgctggagaacatcctcaacaagtacagccagcttgaagagaagtacgatttcgtgctttgcgaaggaaccgactttcagggcaaagaccagaacttcgagtttgacatcaacgcggaaatcgccgccaacctcagctgccccgttcttctggttgcaaacggaagagggaagagcgctgacgacatcattgcatccacccagcttgttatcgatgcactcgaagacaagggcgtagacaccgtagccgcaattatcaataggcttacagctaccgaagaagagaagaatgaaattctgtccagcatcaaatgcaagaccagatgctctcaggaacttcttgtttacggtattgatgaaaatgaaagtctgggtaaccccagcatgaatgatgtacgtaaatggctgaacggttccgtactgtacggccacggaagacttgataccctcgttgatgactatgttatcgcggcgatgcgtatcggtaacttccttgagtacatcgaagacggcagtctcatcatcactcccggtgaccgctctgatatcattttgagctctctggcttcccgtctttccagctctttcccggatatttccggtatcctgcttaccggtggactgcagcccagcgcatccgtacatcgcctgatcgaaggttggaccggtgttcccacccccatcctttctgtatcaaccaatacttatcgtaccactcagctgctgagcgaattgtacggaagaattgatcctgatgatcagcgcaagactgcttctgctctcggtacttttgaagcaagtgtaaagactgatgaactcagacatcgtcttatcaccagcaagtccagcaaagttactcccaagatgttcgagtacaagctggttcagaaagcaaaagccaacaagcagaccatcgtactgcctgaaggtacaagcgaaagagttcttcgcgcagctgatattcttacccgccgcggcgttgcagatatcgttctgcttggtaaggctgatgaagttgccggtaagatttcccagcttggtcttgaaatgaacgatgtgcgtatccttgatcctgaatccgcacctcagtttgacgactactgcgaaacttacttcaagctgcgtgaacacaagggcatccgtatgtctgatgcacgcgaccgcatgctcgatcccacttacttcgcttccatgatggttcagaagggtgatgctgacggtatggtttccggttctatcaccactactgctcagactatccgtcctgcttttgagttcatcaaaaccaagcccggtgcatccatcgtttccagcgtcttcctgatgtgcctcaaagacaaggttctggtcttcggtgactgcgcagttaacccgaaccccaatgcggaacagcttgcagagatcgctctgaactctgctgaaaccgcgaagatcttcggtgttgagccccgcgtagctctgatgtcttactccaccggtcagtccggtaagggggcagatgttgagaaggttaaagaagcagtaaaaatcgctaaggaacgcaatcccgaattgaagctcgaagggcctattcagtacgatgcggctatcgatccttccgttgcgaaaaccaagcttccggatagtgaagttgcaggccaggcaaccgtttttattttccccgatcttaatactggcaataatacttataaagctgtacaacgctccgccgaacagtcagtcgctatcggccctgtacttcagggactcaataagcctgtgaacgacctctcccgaggctgcactgttccggatattgttaatactgtcgcaatcacagcaattcaggcagcagccgaaaaaggacaaatctaa

SEQ ID NO: 1605 - DNA, 2109 bp, Desulfohalobium retbaense DSM 5692
atggccaagaatctctacatcacgaccacggaaccccgcagcggcaagtcggccatcgcccttggcctgatgcagcttttgatgcgggatatccgcaaggtgggcttctttcggcccatcatcaacaccccgtcacgcgacgttcgtgaccacgacatcaacttgatccactcccaattccatctggatatggaatacgaggaatccttcgccttcaccctccaggaagccaaggacctcctcaacaacggtaagcaggatctcctttttgagaccatcctcaaaaagtacaaggaagttgaagcgaaatgcgattttgtcctctgcgaaggatccgacttccaggacaccgcgtcggctttcgagtttgacatcaacgccgaaatcgccgccaaccttggcgctccgctgctgctggtcgctaacggccaccgtaagactgcacaggaagtcgtcagcgcgacccagctggccctcgactcttatgaagacaagagtgtcgacatcctggccacggtcatcaaccgcgcggctccggagatcgaccagtccatcgcccgcgaactgtcctgcacctcctgtaaggacaagtccatgctggtctatgtcatccctgaagaggacaccctgggcaaaccgaccatgtccgatgtcaaaaagtggatcaacgccactgtcctctacggcgaagaccgcatggagaacctgatttccgacaatgtggtcgcggcgatgcagatcggcaattttctggactacatcacgcagggaagcctggtcatcacccccggcgaccgctcggacatcattttgagcagtctcgcctcgcggctttcttcgaactttcctgacatttcaggcatcctgctgacaggcggcatctatccgtcgaagaatgtgctcaagctcatcgacggctggaccggcgtgcccatgccggtcatgctggccaaagaccacacctaccggaccacacgcacggtcgacgccctgtacgggaaaatcgaacccgacaatccgaaaaaaatcgccaccgcgcttggcgtctttgaagccaacgtcaacaccgaagagttgcgcctgcggctggtggaaaccaagtcgaccaaggtcacgccccggatgttcgagtactccctggtcgaaaaagccaaagccaacaaacagcgcatcgtgctgcccgaaggaacaagtgacagggtcctgcgcggggcggacatcattctgcgccgcggcgtctgcgacgtgaccatccttggtgaccccgccaagctcaaggccaaagcctcagaactcggtctggacctcgacggggcccaactgatcaatcccattgatgccgagaaccttgacgactacgccgccgcctactttgaactgcgcaagcacaaaggggtgaccgaggagcaggccaaggacgccatgagcgatcccacctactatgccacaatgatggtccacaaaggcgacgccgacggcatggtttccggatcgatcaccaccacacagcagaccattctgcccgctttccagatcatcaagaccaaacccggcgcttccatcgtctccagtgtctttttgatgtgtctgcgggatcgcgttctggtttacggcgactgcgccgtcaatccgaatcccaacgcccagcagttggccgaaatcgctttgagttccgcagaaacggcccggattttcggcgtcgatcccaaggtggccatgctctcctactccaccggagcctcgggcaagggtgacgaggtcgagaaggtccgtgaagcgacggcgctggccaaggaacgccgccctgaccttttgctggaaggcccactgcagtacgacgccgccatcgacccggacgtggccaaaaccaaactgcccgacagcaatgtcgccgggaaggccactgtgttcatcttccctgacctgaacaccgggaacaatacctacaaggctgtccagcggtctgctcaggccgtggccatcggtccggtcctgcagggcctgaataagccggtgaacgacctcagccgcggctgcaccattaccgatatcgtgaataccgtggccatcacggccatccaagcgcaagcagaaaagggattgatatga

SEQ ID NO: 1606 - DNA, 2103 bp, Desulfomicrobium baculatum DSM 4028
atggccagaaatctatacataacggcaacggaatctcgaagcggaaaatcagccatcgttctgggcgtcatgcaaatgctcctgcgcgacattcgtcgggtcggttttttccggcccatcatcaatgatgttcccgaccgcaaggaccacgatatcgaccttgtcctgtcccagttctatctgggcctgcagtacagcgagacctacgcgctgaccatgcagcaggccaaggaactggtcaacgcgggccagcactccctgctcattgaaaaggtcatcaacaaatacaaggaactggagagcaagtgcgatttcgtgctgctcgaaggcacggatttcgaaggaacgagccccgcgttcgagttcgacatcaacgcagacatcgccgccaatctgggcagtccgctcctggtcatatccaacgcctgtcagaagaccgagcacgagatcataagctcgaccaagcttgcggtggaatctttcgccgacaaggccgtggacattctgggcgtggtcatcaaccgcaccgacgttccggaccgcgaagcactgcgtatcgccctcaagaagtccatgaacaagccggacaccctgctctacatcatccccgaggtggccattctgggcaagcccacggtgggcgacgtcatgaagtgggtcggggcggaagtgctttatggcaaggagaatctgggcgcgcaggtcgacgatatcgtcgtggccgccatgcagatcgaaaatttcctgaattacattgaacgcggcagcctcgtcgtcacccccggcgaccgctcggacatcgtcgtcagcagcctggcctcgcggcagtcgtcgtcctatcccgacatttccggcatcctgctgaccggcggcatccgtcccggcaagagcgtggaccggctcatcgagggctggaccggcgtgcccgtgcccgtgctgctcggcaaggaggccaccttccagaccgcgcgccgcctctacaacatgtacggcaagatcgagccgggcgatcagaagaagatcgcctcggccctcggcgtgttcgaagagaacgtggccacggatgagctacgccagcgcctcgacacccgcaaatcgaccaaggtcactccgcagatgttcgaatacggcctcatcgagaaggccaagaagcacaaacagcatatcgttctgcctgaaggcggcgatgaccgcatcctgcgtgccgccgatatcctgctgcgtcgcggcgtggtcgacctgacgattctgggcgaccccaagtccatcgcttccatgacgtcacagctcggtctcagcctgaccggcgtgaacatcgtcgacccgggcgtttctcccgattacaacgattatgtctccaccttcatggatttgcgcaagaaaaagggcgtatccaaggaagtggcctgcgattgcatggtcgacccgacctatttcggcaccatgatggtctacaagggccaggccgacggcatggtctccggcgccatcaataccacagcccacaccattcgtccggccttccagatcatcaagaccaagcccggcgcgtccatcgtgtcgagtgtgttcctgatgtgcctgaaagaccgtgtcctggttttcggcgactgcgccgtgaatcccaaccccactgcgccgcaactggccgagatcgccctgaactctgccgagacggcccgtattttcggagttgagccgcgcgtggccatgttgtcgtattccaccggcgattccggggcgggaggagacgtggacgtggtcatcgaggcgacccgcatcgctcgcgaaaaggctccgagcctgcttcttgaaggcccgctgcagtatgacgcggccatcgaccccgaagtcggcgccaagaagctgccgggcagccaggtcgcgggccgggccacggtcttcatctttccggatttgaacaccggcaacaacacctacaaggccgtgcagcgcgccgccaacgccgtggccatcgggccggttctacagggtctcaacaagcccgtgaatgatttgagccgtggctgctccgtcgccgacatcgtcaacaccgtggccatcacggccattcaggcccaggccgaaaaaggtttaatatag

SEQ ID NO: 1607 - DNA, 2097 bp, Desulfonatronospira thiodismutans ASO3-1
atggccaaaaatctattcgttatcaacaccgaacccagaagcggcaaatcagccgtctgtctgggcctgatgcagatgctcaggcgcaatattcgcaaggtgggttttttcagacccatcatcaatactctgcaggaaggcaaggtggaccacgacatccacctcatcctgtccaggtttcagctgcagcagtcttatgaggatgcttacgcatataccctggaagaggccagggacctcatcaaccagggcaagcactacgtgctcatggaaaatatcatgtccaagtacaaggccctggaaaaaaactgtgattttgtcctgtgcgagggtacggacttcgtcggcacggattcggcctttgaatatgatataaatgccgaaatagccgccaacctgggctcaccagtaatactcataaccaacgcccagaaaaaaaaccccaagcaggtggtatcccagacccagatggccattgacagctttatagaaaaaggcgtggacatactggccaccatcatcaaccgctcccgggtggaggacaagtatgaaattttgtccgggcttcgctgcaagttccgggacgaggccgactgcctgagttttctcatccccgaagtggagtctctgggcagacccaccatgcatgacgtgcacaagtggctgggaggcgaagtaataagcggccaggattttctggatgtccaggtggacgattacctggtggcggccatgcaggtgaacaactttctggattatgtcactcagaactctctggtcattactcctggagatcgctcggacatcctgctgggttgtttttccacccgccagtccagggcgtatccggaagtggccgggatcgttctcaccggcggtatgcacccgccggcctccatgaccagactgctggaaggctgggctggagtgcccctgcccatcctggctgtagaaggacatacattcaaagtagcccgcatacttacggagctttacgggcgcatcgaccccgaggatgaaaagaaggtggccactgcccttggctcctttgaagaacatgtggataccgaggcactgctcagccgcctggaagccaagcggtccacccgggtcacccccattatgtttgaattcagcctcctggaaaaggccaaagcggacaagaaacatattgtcctgcccgaaggctcttcggaccgggtcctgcaggccgcggatatccttcttcgccggggcatcgtggacctgaccattctgggggagccggacaggatgcgcaccagggcctcccagatggggctgcacctggaaaaggccctgctgttggaccctacatcctccaaggagtttgaagactacgcagatacttatctggaactgcgcaaggccaagggcgtgaccccggaagtggccagggacaccatgtccgaacctacttatttcgggaccatgatggtctacaaagaacatgcccacggcatggtctccggctccatcaccaccacccagcagaccattcgcccggccctgcagttcatcaggaccaagccgggtatctcattagtgtcatcagtatttttcatgtgcctgccggacagggtattggtatttggcgactgtgcagtcaatcccaacccctctgcagagcagctggcggaaatcgctatctcgtccagcgagacggcagtacagttcggagtggaacccagggtggccatgctttcctattctacaggagaatccggtgccggggaggatgtcaagaaagtgcgccaggcgacggaaatagcccggtccaaggcccctgaactgctcctggaaggccccattcaatacgatgctgcttacgaccctgaggtggccagggccaagatgcccgactccaaggtcgccggcagggctaccgtatacatatttccggatctcaataccggcaacaacacctacaaggcggtccagcgcgcagccaacgccgtggccatcggcccggtgctgcagggcctgaacaaaccggtcaacgacctttcccggggatgcacagtggccgacattttgaacaccgtggccatcaccgccattcaggcccagcatgcgtga

SEQ ID NO: 1608 - DNA, 2106 bp, Desulfovibrio salexigens DSM 2638
atgtctaagagcttatatattgcggcgacagaggcccggagcggaaaatctgcaattgttctcggggttatgcagctgcttttgacccacctgcgtaaggtggcgattttcagacccatcattcacgacaacttccatgaacgtgatcacgatattgatctaattctgcgtcattttaaacttccgcaggactacaaaacaacctacgcctatacccagagtgaggccacacgtctgcttaatgatggtaagcattcgttgcttatggaaaacattctcgatcgcttcaagaagctggaagaggattatgatttcgtactctgcgaggggacagattatctcgggggggaggcggcagttgaatttgagataaatcttgatgtagccagtaatctgggctgtccggttctggcagtactcaatgctatggacagttacgaagatgaaatctgcgatcttgccaaccgcaccgttgccatgtttgaggaaaaagggctggatgttatttcggtcatggtcaaccgtgcagccaaggaattttctccggatctaggtgaaaggctgagacgctgtctcaaaagcgaaagcagtcctctggtctacgtactgcccgatgacaagcggctgggtaatccgaccatgtctgacgttgttaaatggttggactgccgggtgctttacggacgtgaccgccttgatacgcccatcgacaattatgttgttgcggctatgcagattgaaaattttcttaagtacgtcaatgacggcagcctgatcattactcccggcgaccgttccgacattattctcgccagcttgtcctcgcgtctttccgatgcttacccaaatgtctccggaattctgcttaccggaggaatcaaaccggccatgaccgtccatcacttaatagaaggatggaagggcgttcccctgcctattctggttgctccgggccatacccataagaccgcccagatcctgcgcggtctgcatggtaagattgatccggaaaatcaggttaaggtactttcggccatgggactttttgagacctgtgtggattcgcatgaattgcagcagaaattggtttccagccgttccacaagaattacgccctatatgtttgagcacacactgttgcacaaggcccgtgagaataagcagcacatagttttacccgaaggcaaggaggagcgaatcctgcgggctgcggatattctgcgccgtagggatgttgtcaatcttaccctgcttgggaatgaacaagagatcaagaagactgcttcggatatcggcatcagcctgaacggtatagaaatcgttgatccggtaaagtcagagtattttgaccgttttgtggatgaatatttcgagctgcgcaagcataagtgcattgtaaaggatgatgcccgtgaccgcatgagcgatcccacctattttggaaccatgatggtgtatactggagtcgctgacggcatggtttccggttccattaccaccacggctcagactattcgtccggcctttgaattcatcaaaaccaagcccggtttttccattgtttccagtgtatttctcatgtgccagaatgaccgggtaatggcgtatggtgattgcgcggtgaatcctaatcctaatgcacaggaacttgccgagattgctatcagttccgcacatacagcgaaaatatttggtattgaaccaaaggtagccatgctttcatattccaccggagaatccggcaagggacagtctgtggataaagtcaaagaggcaactgagctggttcgcaaaatagcacctgaaattgcagtggaagggcctttgcagtttgatgccgctgtggacccggatgttgctgctgagcttatgccggacagcgatgtcgcgggacaggccacagttctgattttccctgatttaaataccggaaacaatacctacaaggccgtgcagcgatcccagccggaatctgttgccatcggtccggtcttgcaaggcttgaaaaaaccggtcaacgacctgagtcgcggatgtactgtacgtgatgttgtcaacactgtggctattactgctattcaggccattgcggaaaaggggatataa

SEQ ID NO: 1609 - DNA, 2103 bp, Desulfovibrio piger ATCC 29098
atgcatcgcgccctataccttaccgccacgggcccgcgcaccggcaagcgcgccatcgccctgggcaccatgtccatcctgagccgcaacatgcaggatgtggccattttccgccccatcatcaatgaaccccagctggatgaccgcgccccggacatcaacctgctgctggaacacttcaagctcaagcaggactactgcgacaccttcgcctacacctaccaggaagtgcgcaccatcatcaatcagggcgaccgcaacctggtcatcgagaacatcatccagaagttcaaggaactccagagccgccacgacttcgtgctctgcgtgggcaccgacttcctgggcaaggacccggtcttcgaattcgaactgaacgccgagatcgcctccaacctgggctgccccgtgatgctcatcaccagcggtgaaggcaagagcgccgaagaagtgcgcgactccctgctggtgacccgcgactccatggccccctactccctggacgtcatcgccaccatcgtcaaccgctccagcctgacccgcgccgaagccgacgacctgagcgatatctttgccgccgacgacaagcccggcctggtctacgccatcccggacgagcccgccctgggccgcgccaccatgcgtgacctgcagaagggcctgaacgccgaagtgctctccggcgaggcccacctcgacgccctggtgggcgactacctcatcgccgccatgcacgtggacaacttcctgggctacctggccaaggaccagctcatcgtgacccccggcgaccgcaccgacatcctgctggcctccatcgcctcccgcctgtcctccagcaagcccgacatcgccggcgtgctgctgaccggcggcatccgtcccagcgccgaagtgagcagcctcatcgaaggctggaccggtgctcccctgcccgtgctgctgaccgaccagcacacctccaaggccttcatgtccctgcaggagatctacggcctcatcgagcccaccgatacccgcaagatcaacaccgtgctgggcctgtatgaccactacgtcaacggcaaggagatcagcgcccgcctgaacatgaccaaacccggccgtatgacgcccatgatgttcgaactgaacctcatcgagcgcgccaaggccaacaagatgcgtatcgtcctggccgaaggcgaggaaccccgcatcctgcaggccaccgacatcctgctgcgccgcgaagtggccgacatcatcctgctgggcaatgaggacaagatcaacaagctggcccgcgaactgcacctcgacatcagcaaggccaccatcatcgatcccgccacctcgcccaagttcgaagactacgccgccacctacgccgaactgcgcaaggccaagggcgtgaccatcgaacgcgcccgcgacgtcatgagcgacgccacctactacgccaccatgatggtcaagaaggacgacgccgacggcatggtctccggtgccgtgaacaccaccgcccacaccatccgtcccgccttcgaattcatcaagaccaagcccggctactccgtggtctcctcggtcttcctgatgtgcctcaaggaccgcgtgctggtcttcggtgactgcgccgtcaaccccaaccccacctcccagcagctggccgagatcgccgtggcctccgccgataccgccaaggtcttcggcatcgatccccgcgtggccatgctctcctactccaccggtacgtccggcaagggtgccgacgtggatgtggtggtggaagccacggccctggccaaggaaaaggctcccgagctctccctggaaggccccctgcagtacgacgccgccatcgatcccaccgtggccaagaccaagctgcccaacagcaaggtggccggcaaggcgaccgtcttcatcttccccgacctcaacaccggcaacaacacctacaaggctgtgcagcgtgccgctgaggccgtggctatcggtcctgtcctgcagggcctcaacaagcccgtcaacgacctgtcccgcggctgcaccgtgcccgatatcgtgaataccgtggccatcaccgccatccaggccgctgccgaaaagcagaagtag

SEQ ID NO: 1610 - DNA, 2109 bp, Desulfovibrio desulfuricans subsp. desulfuricans str. ATCC 27774
atgtacaacggactttatatcacggccaccggccccatgacgggcaaaagcgccattgccctgggagccatgcagctactcagccgcagcatgcgcaaagtggcttttttccgtcccatcatcaatgaaccgctatgggacgaccgcgacccggacatcaacctgatgcttgagtacttcaagatcaactccgactacgccgacaccttcgcctacacccagcgtgaagcgcgccagatcatcaaccaggggtcgcgcaacctgcttatggaaaacattatccagaagtacaaaaaactgctggaaacctatgactttgtactgtgcgtgggcacggattttctaggcaaggacccggtgtttgaattcgagcttaacgccgaaatcgccgccaacctgggtacgcccgtcattcttgtgaccagcgggcaaaagtccacggccgaagatatccgtgaatctctccagatcaccatggacagcctggccccctattccctggacgttgtggcaaccattatcaaccgccgcaacctcacccagacagagcttgacgaactgcgcacccatttcagcaccgaagaccgcaaggccctcatttactccgtccccaacgagccgaccatcggccagcccaccatgggcgacgtgaaaaaaggcctggacgccgaagtcctttttggcgaagaccgcctggacgccctggtggacgactaccttatcgcggccatgcacgtgaacaatgtgctgcactatatcgccaaagaccagcttatcgtcacccccggcgaccgcgccgacgtactgctggccgccattgcctcgcgcctgtcttcctccacgccggacatcgccggtgtgctgctgaccggcggcatccgccccgccaaggaagtgtgcgaattcattcagggctggacggcatctcctctgcccatcctgctgaccaagggccacacctacaataccatgctggccctgcaggaacttatcgctcccatcgagccgggcaacctgcgcaagatcaacaccgtgctgggcctttttgaacagcacgtcaacggcaaggatattgccagccgcatcgtgagcaagcgcagttcgcgcattacgcccatgatgtttgaatttgagctgatcgaacgggccaaggccaacaagatgcgtatcgtgctggccgaaggcactgaagaacgcatcctgcgcgccaccgacattctgctacgccgtggcgtggccgatatcaccctgctgggcgatgtggatgaaatccgcaccaaggccagcaccctcggcctggatctggaaaaggccacccttatcgacccggtcaattcgcccaagtttgacgaatacgccaatacctattacgaattgcgcaaaaagaaaggcattacccccgaacaggcccgcgacaccatggcggattcgacgtactacgccactatgatggtcaagcaggacgatgccgacggcatggtttccggcgcggtcaacaccacggcccacaccatccgcccggcttttgaatttgtgaagaccaagcccggcttctcggtggtgtcttcggtatttcttatgtgcctcaaagaccgtgtgctggttttcggcgactgcgccgtcaaccccaaccccacggcccagcagcttgcggaaatcgccattgcctcggcccatacagccgaagttttcggcattgaaccgcgcgtggccatgctttcgtactccaccggcacgtccggcaagggcgcggacgtggacattgttgtggaagccacaaagatcgccaaagaaatggcccccggcctggcccttgaaggtcccctgcagtacgatgccgccatcgaccccagcgtggccaagacaaaaatgcccgacagcaaggtggccggcaaagccacggtcttcatcttccctgacctgaacacgggcaacaacacgtacaaggccgtacagcgggccgccggagccgtagccatcgggcctgtacttcagggacttaacaagcccgtcaacgacctgtcgcgcggctgcaccgtacccgacatcgtgaacaccgtggccatcacggctgttcaggccgcggcagaaaaagccgccgggcgctag

SEQ ID NO: 1611 - DNA, 2133 bp, Desulfotalea psychrophila LSv54
atgacacaaaatctctacataacagccacagaagagcgtagcggcaagtcagtaattgtccttggtgttatgcaaatgctgatgaaagaagtccggaatgttgccttcttccgtcccattattagcgacacagagcccggcgatgacgatccagacattaatttagtgctcgattattttgatttggatattccctatgaggacacctatggctgtaccctctccaaggcctatgagctcattaactccggcaaagaggatcagcttcacgaccttattttaaagaaatacaagaaacttgaggctgatcacgatttcattctctgtgagggcactgatttcagaggatcagacacctcctttgaggcagaaatcaatgccgatatagcagccaacctcggagcccctcttcttcttgttctctccggccgtaaaaagatcgaaaaagagataatgcaggcaacccagctctccattgatactatgctggaaaaaggtagctcctttgccgcctgcataattaatcgggcagcagaaactatcacccctgaaactttccacaaattacaggcaaaaaaccgcgccctctctcgcattcccttttatgtaatgcctgagaattcgaaccttgccagtcccagcgtgatggatgttaaaaagtggttagatgcatcggtcatgcacggctctgaaaagcttgccggcctggtggaaaactatgtggttgccgccatgcaaattggcaacttcctcgaccatatcaagccgggaagctgcgttattaccccaggtgatcgctcggatatcattttggccagtctcgcctccaaggcatcatctacctatccggacatttccggaattgtcctcaccggcgatatgaaacctgctgaaagcgttcaaaagctcatcgagggttggcagggcacccccactcccattctctccgtggccaccaacacctatcaaacgatcatgcgcctcaatgagctctatagccatatccaggcaagtgactcacagagaatagcaaccgctctgggaactttttccaagcatgttgataccaaagagcttaccgaacatctgatatcgagtataccgaccaccatcaccccgaagatgtttgaatatgccctgatggaaaaagccagccaggacaaacaacgcattgtcctacccgagggcacctgcgagcgcatacttcgagcagcggatatcttactgagacgcggcgttgccaatctcaccctgctgggacccgcagatgaggttaagagccgcgccgctgcctgtggcatggatacacgttgggtggaaattattgatccacaaaacaccaaccttctcgctcccttcgtagatgaatatatgaaggcccgagcccataagggcatgattgaagatatcgcccgggacagaatgacagaccctacctattttggcaccatgatggttcatacaggctatgccgacggcatggtctcaggggcagagaacaccaccgcccataccattcgtccagcctttgaatttatcaagactaaacccggtatatccacggtctcctcggtcttcctcatgtgcctcagtgaccgggtactcgtctatggtgactgtgccgtaaatccaaatcctacagccaaacaacttgccgagatcgccctcagctcagccgaaactgcccgtctcttcggcattgaaccccgagtggccatgctcagctattcaacgggatcatccggtaagggcgaggatgtcgagagagtcatagaggcaaccaaaattgctcaggctctgatcattgagcgcaagctcgatataaatcttgagggccccatccaatacgatgcggctattgatccggatgttgcccggaccaaactgcctaattccttagtggcaggcaaggcgacagtctttaccttccctgacctcaacacaggaaacaacacctacaaggcagtacagagagctgcaggtgccgttgccattggccccatcctgcagggattgaacaagcctgtaaatgatctttccagaggatgcaccgtggacgacattgttaatacggtagcaattaccgccattcaggctcaagaagagaagagactttttgccctgaaaaaatag

SEQ ID NO: 1612 - DNA, 2121 bp, Lawsonia intracellularis PHE/MN1-00
atggctaataagctctatattactgctacagaaaaacgtagtggtaaatctgcagtaacccttggcatgatgcagctactcatgcgacacataagaagtgtagcatttttccgtccaattattgctaatatagatcctaataaaaaagatcatgatattaaccttatccttacaacgtttaatatcgccatgccttatgaggatacttatgcatgttcttttaaagaggctagaacacttatagcagaacaaaaatctcctgttctaattgaaaaaattatacaaaaatacaaacatttagaagataattatgactttattctttgtgaaggtactgattatcttagtaatgattccgcatttgaatttgaacttaatatagatattgctgctaaccttaatatgccacttgctgttattgttaatggaaaaaacaaatctattgaagaccttatttcttctactgttacaagctcagagcttatttttgataaaggacaagatattgcttgcctttttattaataaaacaacattagccatacctgaactagagaattgcaaaaaggctattagtactgcaataggctcacaggtccctattgctatgttccctaataattctgtcttaagtcgaccaacagtatctgatataaaacgttggatgaaagcagaagtaatatatggtgaagaatgcctaaataattcagtcgaagattatattataacaacaatgcaacccaataattttttggaccagttacaacaaggtcttcttattataacatctgcagatagatctgatattgtccttgctagcttagcttcaagactttcaatgacatatcctgatatagctggtattattctcacagggaagtttgaactttcctcacatattactcgtcttatcaatggatggcaatctgttcctgtccctattttaaccgtatcccaaaatagctatcaagctattatgacactctcagaactttacggaaaaattaatgtttcagatacacgaaagatacatatagcactcgctatttttgaacaacatgcagacagtaatgctattacgcaacgtgttattgaaagaacttctgacaaagtgtctcctaaaatgttcgaatttaaactcattgaacaagcacgtcgccataaaatgcgtattgtccttcctgaaggaacagaagatcgtatcctcaaagcagctgaagtactttcacaaagagaagttgcagacataactcttttaggagatatccctacaattcataaaaaaatttcagatcttggactgtctctgcataatgttcagttaattcaaccaaatcaaaaccatgctctatttgaaaattatgtacagacatattatgaattacgtaagcacaaaggaataactttagatgatgcccgtgattggatgaatgataccacttactttggtactatgatggtttataaaaatgatgttgatggtatggtttcaggagctactaatacaacagctcatactgttcgtcctgcgtttgaaattatcaagactaaacctggtgcatctattgtttcaagtgtctttcttatgtgtatgaaagaccgtatccttgtttttggagactgtgctgtaaatcccaatcctactgcagaacaacttgcagacatagctattagttctgcacaaacagcacacgtctttggtattcctgtcagagtagcaatgctctcttattcaactggaacatctggtaaaggtatagatgtagatattgtttctgaagctacaaaaatagcacatgaaaaagcacctcatcttatattagatggtcctattcagtatgatgctgccattgatcctgatgttgctaagacaaaagcaccaactagtgtggttgctggtaaggcaacagtattcattttccctgatttaaatacaggaaataatacatataaagccgtacaacgagctgctggagcaattgctattggaccaattctccaaggtctaaaaaaacctgtaaatgatctttctcgtgggtgcactgttacagatattattaatacagttacaattacagctattcaggcacaagcagaacaagggttaataacaatagactaa

SEQ ID NO: 1613 - DNA, 2031 bp, Lyngbya sp. PCC 8106
atggaattgctgtctaaacgcattggtcgattaggtgtttttcgtccgattattcatcgtcgagatcaacctgatcccgatattgaattaattcgcacccgttatcaacttgattttccctatgaatctctctacgctttaaatcacgaacaagcccaacatattgtcgccgagggacattatgatcaactcctcaaagttattctagaaaaatataaaaccctagaacaacagtgtgattttattgtttgtgaaggcgctgatacagttgatgtaacttccgcttttgattttgatttgaatgttcaagtcgccaatgatttaggttcagcaattattattgtcgcgaatggacaggaaaaaacacccgaagaagtcgttgatggagttcgctccgaacgagaagcttttatcgaggaaggatgtacaattgcagccacaattgttaaccgagttttacccgaaaatgttagcacaattaccgaaaaatttcaaaactgttggtcgtctgaagatccggtttttgtgttacctgaagaagaaattctttggaaaccaaccattggagaagttgctcaaaaaattaacgcaaaattcattcatggcgatggagatcaactcaatcgtgaagtccatgattgcaaagtggcggcgatgcaagttcctcatttcctcgaacacatcgacgaaggaagtttaatcgtcactcccggagatcgggctgatattttgttaagttgtttagtggcaactttatcagataattatcccaatattgccggaattatcttaacgggaaatatccaaattcctctgagtatttataaactcattgatgggtttagccagtggagtgtaccgattatgatggttaaagaagatacgtttgaaaccgcaacgaaaatcagtcaagttcgagcgagaataaccgcagataatcctcgtaaaattgccaccgctttaggaatatttgagtcctatgtgcagggttcaaaaatagaagaacgcatctctgtttctcgctctcatcgccgaactccgttgatgtttgaatatgagttaattgaacgagctagaaagaataaaaagcatattgtcttacccgaaggaaacgaagaacggattttacaagccagtgagattttattacgacgaggtgttgttgatatcacgctgttaggtcaagagttagaaattcgtcaaaaaattgcggctttaggattaagtttagatggtgttaatattgttgatccgaatacttcagattggtataaagactatgcagaaacctattttgaactgcgaaaacataaaggaattagtcgagattgtgccgccgatgtcatgcacgataatagttattttgcaacaatgatggtgtataaaggggttgcagatggaatggtttcaggagcggttcatacaacggctcacacgattcgtccagccctagaatttattaaaactcagccgggatgttcgattgtttcgagtgtgtttttaatgagtttagaagatcgggttttggtgtatggagattgtgcagtaaatccaaatccaaatcctcaacaattagccgatattgccattagttcagcactcactgcgaagatgtttggaattgaacctttagtggcaatgttgtcttattcgacgggagaatcagggaaaggagaagatgtggataaagttcgggaagctactcaaattgctcaacaattacgcccggatttaaaactagaagggccgattcaatatgatgccgccgttgatgaaagtgtcgcgaaaacaaagttaccgggaagtgaagttgccggacacgcaaccgtgtttattttccctgatttaaacaccggaaacaacacctataaagcggttcaacgttcagcaaatgcggtcgccataggtccggttttacaagggttgaaaaaacctgtcaatgatctcagtcgcgggtgtacaattaccgatattgttaatactgttgctattaccgccattcaagctcaatctcagggaattaactattag

SEQ ID NO: 1614 - DNA, 2109 bp, Arthrospira maxima CS-328
atggctgagaacctctacattgctaccattgaacccgggagtggcaaatccctagtcgtactcggaatcatagaattgctttccaaacgaattcaaaaattgggatttttccgtcccattattcgtagtcacaccactcctgacagagatatccaattagttcgcagtcgcctacaccaagccctaccctatgaatcttactatgctctcacccacgaagaagctcaaaatttgattggtgagggtcgctatgatgaagtcattaagcaagtcatcgaaaaatataaagccgttgagcaagattgtgattttgtagtctgcgagggaaccgattttactgatatcgcttccgccttcgagtttgattttaacgtccgatttgctaaccacctaggttgtcccattttgattgtagccagcggtagcggtaaaacccccaatcaattaatgagtgccttactagccgaacgggaagcctttattgaagaaggttgcgcgatcgccgctactgtagttaaccgtgtcgataaccacaatgttccaggaattatggaacagttgacaactctctggaaatttccagatcccctatttgtcattccagaagaacccattttagctaaacccacagtcgccgaaattgcccagaaactcggcggtcaacaaatctatggcccatccgacgatcgccttaaccgcgaggtttttgatttgcgcgtcgccgccatgcaagttcccaatttcctcaaatacctcaaagaaggtagcctaattattaccccaggcgatcgggctgatattattctcgcctgcgccgtcgccgctacttccgagaactatcctaatattgccggaattattcttagtggcggtctggaactaccagccactatccaaagcctcatcgatggatgtccccattgggcagttcccatgatcacagttaagactgatacctacgaaactgccatgaatgtagaccgggtacatggtgctattaccccggacaacgatcgcaaaattgcctcagctttggggttatttgaaactcatgtcaacttgggtcaaattgaggagcgcatacaggtttcccgtccctctcgcatgactccgatcatgtttgagtatcaattgattcaaagggctaaagctaatcgacagcatattgttctacccgaaggacgcgaagatcggattttacaagccgctgagattttgtggcggcggggagtcgcagatattaccttattaggttcagaagcagaaattcgcggacgtattgccgccctcggtttgaatttatcccaagtccagattattgatccggctagatccccctggtatgaagactatgctgaaacctattttaatctccgtaaacataagggtattgctaaagacggggcctatgatgtcatgctcgatgttagctattttggtaccatgatggtttataagggacacgctgatggtatggtgtcgggagcagtccataccacaggtcacacgatccgccccgctttggagtttattcgcaccattcccggtacttctattgtctctagtgtctttttaatggggttggaagatcggattttggtttatggcgactgtgccgtaaatcctaatcctaatcctcaacaattggctgatattgctatcagttccgctttgactgctcaaatgtttggcattgaacctagggtggctatgttgtcttattctactggagaatccggacagggtgaggatgtcgaaaaggttaagcaagctaccatcatcgctcgtcaactgcgccccgacttgaaaattgaaggcccgatccagtatgatgctgctattgatgagagtgtcgctaaaactaagctacctgatagccaggtggctggtcgtgccacggtttttatttttcccgatttgaataccgggaataatacttacaaggctgtacagcgatcagctaatgctgtggcgatcggaccaattttgcagggattgaaaaaacccgttaatgatttgagtcgcggttgcaccgtcaccgatattgttaatacagtagcaattactgctattcaagcgaatctaggcacacattttcactcccattaa

SEQ ID NO: 1615 - DNA, 2100 bp, Syntrophobacter fumaroxidans MPOB
atgtcaaaggggatctacatcaccggcacggggcccgggagcgggaaatcgttgatcgttctcgggatgatggagttgctggcacagcacggccgaaagctcgggttctttcgacccgtcgccgttgaagggggcggcgtcgatcggctggcggcactcgtcacgagccgatacgccatcacggccccgggtgagagcatgttcggcgccagttatgcctccgctcgagacctcattgccggggacaagatggacgagttgcagagtcgaatcatcgagaagtacgaggccctggagcggcaatgcgatttcgtggtctgcgtgggcaccgattacagggccgtgcacacggcgctggagttcgagtataacgttgaagtggcgcggaatctcggcacgcccctcatgcccattgtcgcggggcggggaagaaccccgggagagatcgtggattcggtgcgaatcctggcggagtttctggaggcacggaagtgcgaccttgtttcggtgttcgtcaaccgggttgcaccgggccatgtgaaggaggcggcgactcgactcgaggaaaatgcacccgcggggattcccgtgttcgttttgccggatcacccaatgctcgacaaacccacggtgggcgagataatgagggctctcggggcgggaatggtgcacggagacgcgaaccggctcgaccgtgaagtgaccgggtacagggtggcggccatggaactgcccaacttcctggatcacctggtggaaggttgcatggtcatcacgcccggtgaccgctccgatatcctcatcggaacactggcggcggatgcggccacttcctacccggggattgccggcgtcgtcctcacggggggcttcaagcccgcgccgcaggtgcagcgtctcttcgaaggcctgaggcgttcgcccgtcccgatcctccatgtggacgccgacacttttgagacggtaacagaggtgaacgccgtgcccgcgggcctctcccccgagaatcagaggaagatcgccggcgccctcggggtcttcgaatccaacgtggatgtgagccggttggagggccggatcgcggtcatgcgttcctcccgcgtcacgccgctcatgttccagcacgatcttctgagcggcgcgcgggccaagcgccggcacatcgttcttcccgaaggcaccgagaaacgtatcctcagggcggcggagatcctccagctacgggacgccgttgacatcacgctgctcggaagccccaaagaggtcggcgagaagatcacctccctcggcctgtccctccccggtgtcaagatcatcgacccaatgacgtcggagctccgcgaggatttcgggcggacttatttcgagctccggcaacacaaggggatttccctgcagatggccctggacgccatgtccgacgtcagctatttcgggaccatgatggtctgccggggcattgccgacggcatggtctccggggcggtccattcgacgcagcacacgatccgtcccgccctggagatcatcaggacccggccgggctgcccgatcgtctccagcgtcttcttcatgtgtctttcggaccgcgttctcgtttacggcgattgcgcggtcaaccccgaccccgatgccgagcaactggcgcacatcgccatcagttccgcttcaacggcccgcaatttcggcattgagccgcgtgtggcgatgctctcgtactcgacgggggaatccggcaagggagccgacgtcgaaaaggtgaaggaagcgacccggctcgccaggcggctttgcccggacctcaagctggagggccccgttcagtacgatgccgccgtcgatccggacgtcgccagggtgaaactgccggagagcgaagtcgcgggccgtgccaccgtcttcatcttccccgacctcaacgccggcaacaatgcctacaaggcggtgcagcggacggcaaatgccgtcgccataggtccggtcctgcaggggctgaacaaaccggtcaacgacctgagccggggatgcaccgtcaccgacatcgtcaacaccgtcgccataaccgccatccaggcccagatggaaggagacgccacatga

SEQ ID NO: 1616 - DNA, 2121 bp, Allochromatium vinosum DSM 180
atgcagagtatctacatcgccggcgccggggctggcagcggcaagtcggttgtcgtcctgggcttcatggagatgttgtcggcgattggccgccggatcggtttctttcggccctttgcgccccggggagccgaactcgacaatctaacggccctgatccgcgaacgttacgcgctgccgttcccgcccgagatgctctacggctgcaccgtggagacggcacgccagttcatcggcagcgggcgctatgacgagctgctcaagctcatcatgaacaaattcaagatgctcgaagagcagtgcgatctggtcgtctgcgccggcaccgactacaacggactcatcccttcgctggaattcggcttcaacgtcgatctggccaacaacttcggctgtagcctggtggccgtggtcaagggcttcggacgtaccccgcaggaagcctgggacgccctgcacatcacccatgagctgatgcgcgagcgcggcggcgacttcctggccaccgtggtcaatggtgtggcgccgcaggatctggagaccgtgcgcggccgggtccagcatctgctcaccgagaccgagaccatctatgtgctcccggagcagcaggcgctcggcatgccgaccgtgggcgagatccggcaggcgcttggcgccgagtgtctctatggcgagggcgacgccctgcatcaggtcgtcaccaactacaagatcgccgccatggagatcccggatttcctgcgctatgtcgaggacggctgtctcatcatcacgccaggcgaccgctccgacatcatcctggcgagtctggccgccgatgcctcctcggcctttccgcgcgtggccggactgctgctcaccggcggtctgcgaccggccgacaaggtccgcgatctgatcgagggcctgcgtcgcaccaaggtcgccatcctccaggtgccgaccgacaccttcaccacggccatgcatgtgagccggatcgaatcgagcctgctgccgggcgacgatcgcaagatcgccgccgcgctcggcgtcttcgaggcgaacgtcgatctcgacgagttgcgcggacgcatcgccgtgcatcataccgagcgcgtcacgccgctgatgttcgagtacgagctgatccgccgcgccaagtcgcgccgccagcgcatcgtgctgcccgagggcggggacgagcgcatcctgcgtgccgccgagatcctgtcgctgcgccaggtcgccgacctgatactgctcggcaatcccgagcgcatccagcgccgtgcggcggagttgggcctggatctcggtgacatccgcatcatcgatccgatcgactcgcccgatcgcgaccgctatgcccggacttattacgagctgcgcaagcacaagggcatctccgagcagatggcgcacgacgtgctggccgacgtcagctacttcggcaccctcatggtctaccacggcgatgccgacggcatggtctcgggcgcgacccacaccacccagcacaccatccggccctcgttcgagacggtcaagaccaaaccgggcgtgaagctcgtctccagcgtgttcttcatgtgtctgccggaccaggtgctggtctatggcgactgtgccgtcaatcccaatcccgactccgaggagctggccgacatcgccatcagctcggcgcagacggcgacggccttcggcatcgagccgcgcatcgccatgctgtcgtattcgagcggcagctccggcaagggcgaggatgtcgaccgggtgcgcgaggcggtgcgactggtgcgcgagcgccggcccgatctcaaggtcgaggggccgatccagtacgatgcggcggtcgacatcgaggtcggacgttccaagatgcccgacagcgaggtcgcgggtcatgccacggtgctgatcttccccgacctcaacaccggcaacaacacctacaaggccgtgcagcgcagcgccggtgccgtggccatcggcccggtactccaggggctgaacaagccggtcaacgacctcagtcgcggctgtaccgtgaccgatatcgtcaacaccgtggccatcacggccatccaagcccaaggcgagtccatcgcggccgccgccaacgaggagtgcgcgcgatga

SEQ ID NO: 1617 - DNA, 2100 bp, Rhodopirellula baltica SH 1
ttgattcaacgcagcgtctacattggcaccaacggcaacgcgaccggtaaacgcatggtcgccctggggatgatggaattggcggctcggcgattcggtcgggtggctttctttcgcccggtcgtccatgtcggccccaacgaagaccaaagcatccgcatgatgcgatcccggtatgggatcgtcactcccgccgatgagatgttcggtgtcacacgggcacaagcccgacaaatgttggcggatgaccgatacagcaacctcattcagctcattcaacaacgcttcaagtcattggaagcgaaggccgactttgttgtcgtcgaaggcaccagctaccaaggcctcgcaccggagttggagtttgaactgaatgcggacatcgccgccaacatcggttcgcgagttctctctgtttacgcaatgggcgatcgctcagtcgatgaatgcgttcaatccgtgctgattggaaacgagagttttgtggatcgaggcgcccagttgatcgcgacgatcatcaacaaagtccccgacgatcaatcgactgctctgaacgcggcgatcaagacatcaaaattggattccaaagcacctctgtactttcttcccgatgagccgttgcttcgccaaccaacggtccgtgaaattcaatccggcatcggtgccaaactggtttctggcgatgagtcctccctggatcgtgaagtcgcggttcgcaaagtcgcggcgatgcaactgcctggctttttggaacggttgtccaacgcggccttggtgatgacacccggtgaccgcagcgacatcctggtcggctgcgtgctggcttgttcgcaacccgacggaccatcgccggctgcggtcgtactgaccggcggaatcctgccacctccatccatccggcgtttagtggaaaacgcgaacgcattgccgattttggttgctattgaagacacttacacggtcgcctccaaggccgctgaggttcgcgccgaaatcggagatcactccccgagaaagattgaatctgcgatcggagtcttcgaacgtcacgtcgacacggactcgctggccgatcgactgcaagctcccatcgttccgcgaatcacgccgatgctgtttgaacactcgttgatccagcgggcaagacaacaacgcgtcaaaatcgtattgcccgaagcaaccgaaccgcgaatcctgcaagccgtcgatgtgttgcggcgtcgcgatgtgaccgatgtggtactgctcggcgatcccaatctgattgccgccgcggcggcgcgggcgggcgtcatgcttcccaacgacgggctcgagatcattgatcccgcgaccagtccactcaggaactcgttcgctagtgagtactatcagcttcgtaaacacaaaggcgtcaccaccgacatcgctcatgaccgaatgatcgatgtcacgtattttggcacgatgctcgtgcatcgcggtttggcgggcggtttggtttccggcgcggttcacaccaccgccaataccatccgtcccgcgtttgaattcattcgcacgcgacctgatgtcaacgtggtcagcagtgtatttctgatgtgtttgaagaatggggtgctggtgtacggtgactgcgcagtgatccccaatccgaccgccgagcaactgactgaaattgcaatcagcagtgctgaaacagccgtgcagtttggcattgaaccgcgaattgccatgctgtcttattccaccggcgaaagtggccatggagaagatgttgacaaggtgcgcgaggcgacggcgatggttcgcaaacgacggcctgatttgctggtcgaaggccccctgcaatacgacgccgccgtcgatcccgacgtcgccgcaacgaagatgccgggcaaccccgtcgcgggacaagccaccgtgttggtcttccccgacctgaacaccggcaacaacttgtacaaagccgtccagcgatccgcgggtgccatcgcaattggtcccgtcctgcaaggattgaacaaaccggtcaacgatctctctcgcggatgcacagtgacggacatcgtcaacaccgtcgcgatcacggccatccaagcacaaacggtggcttcatga

SEQ ID NO: 1618 - DNA, 2079 bp, Sulfurimonas denitrificans DSM 1251
atgaatgtacaatcgctttatatcttggcactagaaaaaaatgtaggctctctttttataaccatgggaattatggagatattaaagagaaatataaataaagttgctttttttcgtccaattatcaccgataaaaatgtagtagataaagatatagagtttatctcacaaagatacaatttagagatgagttatgaggagtgttacggatttgatttgagtgaggttgatgcaattatcgcttcaagtggagttgatgagcttattatgagagttgttgagaaatttaaaaaacttcaagaacgttatgagtttatactttgtgagggtattgctcgttctttgtttacatcaaattcaaatcataacttaaacgcactacttgcccaaaattttggctcatctatcataaccatttttagtgcaaaagagcactcacctctagaagtatatgagagcatcgccatagagaaacagaaccttctctctttagatattccttgttttaatatgtttgttagtagagttgatgagcaaagttatctggacttaaagcgtgtgctaaaagattactcttcaaatatctcttttttaaaagagttgccagagcttgatgtacttactttagaggatgtcgttgagactcttgatgttaaaaaaatagttttttctcaaaatgataatgcaagggcagttcgtggttttttcgtcgcttctttgggagttgacgagtttttagatgagataaaagatgatgatttggttatagtagatgcaaagaggtcagatatcattttagctcttatagcctcattttactcaaaagagtatccaaaaatcagtgcagctctttttgtgggcgattcagaacttactcaaagtctcaaaaagcttattttaggactccatgagtataaaattccatttttaagtataaagagcaatacatttgagagtgtaaaaaaactgctacatgtatatccgcgccttagagtaaagagtgagcgaaagatagctctagcacttggactctttagtgcaagtgttgatataactgcgtttgagcagaagataaaagtacaaaatagcgatgttatgacgccaataatgtttcaatataaactatttgaaatggcacgcaaaaagaagaaaaatatagttctgccagagagtagtgatgagagaattttaagagcagctgagatagttcttcgtcgtgatgtagctgatatcactcttttgggtaaagaagaagagatacgcgaacattgtcagaaacttgggctagacataagtaaagcaacaataatagaccataaaaaatccaagcgcctagaagagttcagcaatcttttttatgagatgagaaaagccaaagggataacacttaaagctgcaagagatgccatgatgcacagaaactattttgcaacaatgatggtacatgtaggattggcggatggtatggtaagcggagcaattcactcaacagctgacactctaagaccagcactccagataataaaaacaacatcagatgttgagatagtatcaagtatcttttttatgtgtctaaaaaccaaaattttgatatatggtgattgtgctctaaatcaaaatccaaatgcaaaagaactggctcaaatagcaatatcaagcgcaaaaacagcggagctttttgatatcacgccaaaggtggcgatgctctcatactcaactggagagagtggaagtggcgcagatgtggataaggtaagagaggctactatgattgtaaaagcattaaggagcgaccttgaaattgatggtccattgcagtatgacgcagctgttgataaaagtgtagcctccatgaaacttccaaactcaaaggtagctggagaggcaaatgtctttatatttccagatttaaatacaggcaataacacctacaaagctgtagaacgctcaagcggtgcattagcaattggaccgattttgcaaggacttaaaaaacctgtaaatgatttgagtcgtggatgcagtgaagctgatgtgctaaataccattttaataaccgcaattcaggcaaatatgtga

SEQ ID NO: 1619 - DNA, 2082 bp, Campylobacterales bacterium GD 1
atgaaaataaaatcgttatatatatctgcacaagaaaaaaatgccggaactctgtttatatctatgggaatgatggaaattttaaaaagaaatatgcctcatgttgctttttttaggccagttatctattcaaaacatattgaagatggagatattaacttcatgctaaatagatataatctagaaatggactataaagattgttatggttttgacatagaatatgttgaaaatatgattgctaacaataaaactgaccagttgatgaatgagtttattacaaagtttaaaaaacttgaagacaagtatgattttgttctagtagagggaattagacactcttttttaacctctacaatcaattttgatctgaatataaaaatagctcaaaattttggctcaccaatcataaatatagttaatgcaaaaaataaaacaattgcggatattcatgatgatattttaatagaaaatgaaaattctacatttcaagggtgtactcattttgcaacttttataaatagattagatgataaacaagatgaagcgcttaagaaaaaacttaatgactaccctttaaagatttattttttaaaagaggttgatgaacttggaatgttgagtatagcagatgtcatagactcactagatgcaatacctatttttttacagccaaaagatattactagaatcgttagagggataaaagttgctgctttaacgttgaataattttttagatcatgtagaggaagatgatttagttgtagttcctgccgatagatcggatattattttaggcttgtttggagcactttattcaaagaattatcctaatattagtggtattgtttttccttttgggatggaagctcatccaaatataaaaaaacttatagatggattaaatagttttagtattcctatattgtcagtagatgatgacacctatatgacagctaacaagttatctaaagcacaagcaagattgcgggtgactagtgagagaaaaatagcacttgctcttggtctttttaactctagtgtagatatagaagctattgaaaagaaaatagctactgtagttagcacagttttaaccccaatgatgtttgaatataaactatttgaaagagcaagattaaataaaaaacgaatagttttacctgagagtaatgacgaaaggattttaagagctgctgagattattttacgtcgagaggtcgctgacataactctgctaggcaatagtgaaaaaataactgaaacttatttacgattaggtttagatctaagtaaagcaactattatagaccatcatacgtctaatcttagaaaagagttcgctgagatcttttatgaaatgagaaaagagaaaggtttaacattacaggctgctgaagatgcaatgactcatggaaactattttgcaacaatgatggttcatcttggacatgttgatggaatggttagcggggctattggctcaactggtgagacaatcagaccggctcttcaaatcataaaaacaaaaccaaatatttctatagtatcaagcgtattctttatgtgccttaaaaaagaggttttagtctatggtgattgtgctgtaaaccaagatccaaatgctgaggaactggcacagattgcaatctcatcggcagagacagctcaagcatttggattagaagcaaaaatagcaatgctatcttattcaactggagagagtggtagtgggattgatgttgataaggttagagaagctactaaaatcgttaaaaataaaaaaccaaacctacttatagatggtcctattcagtatgatgcagctgtaaataaaaaagttgcttcaacaaaactaccagattcaaaagtagctggagaggctacagtattgatttttccagatttaaatacaggtaataatacatataaagcagttcagcgctcaagtggtgctgttgccattggcccaattttgcaaggattaaaaaagccaataaatgatttaagtcgaggatgttcggtctcagacattgtaaatacagtcgcaattacagcaatacaagcaggacaggactaa

SEQ ID NO: 1620 - DNA, 2109 bp, Sulfurospirillum deleyianum DSM 6946
atgcaaaccaaaagcttatatatctcgtcgttagagcccgcagcgggtagtttgatcgtaacgatgggcattatggagttgcttaaaggtcgtcttggaagggtcgctttttttagacctgtcattgttaatgtaggtgaacctgatcaagatatcagttttatgctcgaacattatgcccttaaaatggcgtatgacgatacttatggttacactgtgcatgaagttgaaagtctgattgctgaaaataaatacaatgaggttttagagacactgattgaaaagtttaaaaccttagaaaatcagtacgattttgtgctcgttgagggcttaaatcaagccaatttctcaaatacgctcgattttgatattaacctctccatcgcaaaaaatttaagtagtccttttattagcgttttaaaaggaaaaaataaaagtgttaaagaagttgtcgatgagattcatattgaagcagaagcgattcgagcagcaggatgtcaacactttgccacatttgtcaatcgtttaggaaaagcggaatctgaagcacttcaagaacttgctgcttctgttgcgttgcaaaacagccctatttattttcttccagaagttcccgaattagatactccaaccgttgctgaaattcaaaaaaaattgggatgtatgcgtatttacggggaagaaaaagatttaagacgtgtggtaaagcagagtaaaatcgcagcgatgcgtttagagaattttttagaacacattgaagaaggtgatttaatcatcacaccaggtgatagatcagatgttattttagggtgtcttagtgcggctttatcgaaaaattatccaacgatttcaggtatgttattgacaggtggtttattgccagataaagcgattaataaactctttttaggttttaatgatttttcgattcccgtgttaagcgttgaaagcgacacttatcatacggctgtaaatgttgcacaagttcctgcgaccattacggcacagagtattcgaaaaattgcacttgcaatgggacttttctcatctaacgttaatctcaaagagatagaaacgatgattaatgcggagtcttctctttcgtctattacccccgttatgtttgaatatgcactctttgagcgtgcacgcagtgaccgtaaaaaaattgttctacctgaaagtaacgatgagcgtattttaagggcaacggagattttattgcgccgtaatgttgcggatattattcttctaggaaaccctgaagaggtcttgcgtaaaagtgcttcattggggttagatattggcaaggcgacgattattgaccctgcaaattcacctctgatggatgaatttgtgcgtactttttatgaaatgcgaaaatccaaagggctctctttagatgtggctcgtgatagtatgatgatgaccaattactttgctaccatgatggtttattcagggcacgctgatggaatggtttcaggtgcgattcatacgacacaagagacgattcgtccagctcttcaaattattaaaacaaaaccgggtatttctattgtttccagtctcttttttatgtgtttagagacacgtgtgttagtgtatggtgattgtgctgtcaatcaagaccctaatgcggaagagttggctcaaattgctatctcctcggcggatacggctaaaatgtttggcattgaaccaaaaattgcgatgctttcttattcaacaggtgattcaggtaagggtgaagaggttgaaaaagttcgccttgctacaaaaattgttaaagaaacacgtcctgatttattggtcgaaggacccattcagtatgatgctgcgattgatccaacggttgcaaaaacaaaactccccaacagtcaagttgcaggagaagcgactatttttattttcccagatttaaatacaggtaataatacttacaaagcggttcaaagaagttcaggtgctgtggctattggtccagtacttcaagggcttcgtaaaccagtcaatgacctcagccgaggctgtttggttcctgatatcgtcaataccgtagccattactgctattcaagcacaaaccaacgatggagtaagcaattga

SEQ ID NO: 1621 - DNA, 2100 bp, Sulfurovum sp. NBC37-1
atgcaacatgcaagcatctacatcgcttccacagaagcccagtcgggaaccatgatcattgctattggcttcatggagatgctcaaaggacgctataccaatgtcgctttttttcgccccatcattcctgaccaaaaagaagatgaaacccacatcggtttcatgcgtgaacatttcgggctgaagatcccttatgaagcctgctatggattcacagagtcagaagtcattcaggcctttgcggatgaccttgaagaggtactatttgaagcactcatggccaaagtggataagctgcacagggagtatgattttgttatgatagacgggtatccgagaaaccggtttgcctctacctttgatttcgatatcaacctcaagatcgccaaaaacctcggtacggcttttattcctgtgatcagtgcctggaagaagaacagtgatgagatcatcaatgagatccagatcatcacagaggccataaaaaccgaaggctgcagcgaacttgccacctttgtaaaccgctgtgatgatgagtgcatgaaaaccgtactgcaggaagtagaaaatttaggaaaggagaaacaggtctatattctccctgaggtgaaggaagtcgatactcctacactgcggcagatcgtcaaaacactcgatgccaaaatgatcctgggagaaggagagcagctcaaccatttggtgcgcagtactaagatcgtggcgatgggtgtagaaaattatcttttgcgtatcgaagacgagcatcttatcatcgtaccggcagaccgcaatgacatcatactggcttctctcctctcctatgcagcaaagaatcaccctaacattgtcggaatgatactcagtggcggcatagaacccagcaataccattatcgatctgatcaaggatttttccgcttctgctcctattcctatttttaccatacacagtgacagctatgaaacagcaattgcagtggctaaagtccaggcaaagatcagtcccgaagacacagacaagatcacgctggtcaaagtgctcttcgacaaatatgtcgacaaagagagaatagctcagaaattcagacagagtcaaaacaatgtaatgacacccctcatgttccagtacagcctttttgaacaggcacgctccctacgcaagcgtatcctcctgccagaaagtgatgatgagcgtatcctcaaagctactgctatcctcctgcagagagatatcgtcgatatcattctgctcggagaggaagagagtgttcatcatcgagcggcacagctcagagtcgatatttcaaaagcacagatcatggagccggccaaaagtggactgattgaaaagttctcccggcagttccaagctctccgtgcctccaaaggactgacactcgataccgcccgagatgccatggaacacaaaaattattttgctacaatgatgctttacaacggtatggcggacggtatggtctcaggagcgacgcataccacagccgataccatccgtcctgctctgcagatcatcaagacaaagcctggtatttccatcgtctcaagcatctttttcatgctgctggatacaaaggtactggtctatggtgactgtgctgtcaacctcgaccccaatgccgaacaactagcacacatagccatctcctcggcagataccgctgcccagttcggcatagaaccacgggttgccatgctttcctactctacgggggattcagggagcggtcctgatgtcgagaaggtaagagaagcgacaaaaatagcccagaagatgcgccctgaccttcttatcgaagggcccatacagtacgatgccgccatcgacatgaaggttgccagaaagaaactgcccgacagtaaagtcgcaggtcgtgcaacagtattcgtcttcccggacctcaatacagggaataacacctacaaagcggtacagcgttccacgggtgccattgctatcggtcccattctacagggactgaaacttcctgtcaatgatctcagccgcggctgtctggtcgatgacattgtcaataccgtggccattacagcggtacaggcacagcacctggatagatcatga

SEQ ID NO: 1622 - DNA, 2079 bp, Mycobacterium vanbaalenii PYR-1
gtgcctgacgccacgacgggaaccacctcctcgatctacctggcgtcgccggaaggcgacaccggaaaatcgacgatcgcgctgggcatcctgcaccggctctcggccaccgcggccagggtcggggtgttccggccgatcaccaggatgggcgagagccgggactacatcctggagttgctgctcgaccacaccaccgcgggactgccgtacgaggactgtgtcggggtcggctatcagcaactgcacgacgatcccgacgccgcgctggccgagatcgtcgaccgcttccaccgcgtcgccgaccggtgtgacgcggtgctggtggtcggaagcgactacaccgacgtggccgcgccgagtgagctgtccgtcaacgcccgcatcgccgccaacctcggtgcgccggtggtgctcgcggtcaagggcaagggccgcacccccgagcagatcctccaggtcgtcgacgtgtgcatcaacgagatcgccgcccagcacgcccacaccgccgccgtggtggtaaaccgttgtgacccgatcctgttggtcgacgtcgccgaggccctggcgagtatcggaccgcagagctacgtgctgcccgaagaacccctgctggtcgcgccgtcggtttccgagctgcgcagcgcggtcgaaggccaccaggtgcagggggacccggcactgctcgaccgcgaagtgctcgacgtgctcgtcgcgggcatgacggccgaacacgtgctggagcggctcaccgaaggggtcgccgtagtcacccccggcgaccggtccgacgtggtgttggccgtgctcagtgcccacgccgcagcaggattcccctcgctgtcggcagtcatcctgaacggcgggctcacgttgcatcccgcgatcggatcgctggtggcgggtctggggctgcgtctgccggtcatcgagaccaggctcggcacattcgagaccgccagccgcatcgccgcgaccaggggacgggtcacctcgaagtcgcatcgcaagatcgacaccgcactgacactgatggacacctacgtcgacacagcggaactgttggcgcacttggctattccgattcccaccgtggtcaccccgcagatgttcacccaccagctgatcgagcaggcccggtccgaccgcaagcgcatcgtgcttccggagggcaacgacgaccgcatcctcaaggccgcgggccgactgctgcaccgcggcgtggccgacctgaccattctcggtgaggaggcccaggtcagggcacgcgcggcggaactcggccttgacctgtccaccgcggtggtgctcgacccgcagaccagtgagctgtgcgatcggttcgccgagcagtacgcgaagttgcgggcacacaagggtgtcaccgtcgagcaggcccacgagatcatccacgacgtgtcgtatttcggcaccatgctggtgcacaacgacctggtcgacggcatggtctccggcgcgtgccacaccacggcgcacacgatcaggccggcgctggagatcatcaggacggcgcccggggtctccacggtgtcgagcatcttcttgatgtgcctggcccacgaggtgctcgcctacggcgactgcgcgatcgtgcccgaccccaccgccgagcagcttgccgacatcgcgatctcgtcggcgcggaccgccgcgcagttcggcatcgaaccgaaggtggcgatgttgtcgtactcgacgggtacctcgggcaccggtgcggacgtggacaaggtcaggaaggcgacggagttggtgcggtcgcgggcgcccgagctgctggtcgaggggccgatccaatacgacgccgcggtggaaccgtcagtcgcgatgacgaagatgcccgactcgcgggtggccgggcatgccaccgtgctgatcttcccggacctcaacaccggcaacaacacctacaaggcggttcagcgcagcgcgggcgccatcgcgatcggtcccgtgctgcagggcctgaacaaacccgtcaacgacctgtcacggggcgccctggtggaggacatcgtcaacaccgtggcgatcaccgcgatccaggcgcaggggtga

SEQ ID NO: 1623 - DNA, 2124 bp, Mycobacterium gilvum PYR-GCK
gtgcgcgcgggggcacaatttggcaggctttgggacgtgcccgacgctgcgaagacgaccatctccgccatctacgtggcgtcgccggaaggtgacaccggaaaatcgaccatcgcgctgggaatcctgcaccgtctggccgccaccgtcgcccgcgtcggggtcttccggcccatcacccgcggggacggggcgccgcgggactacattctcgaactgctgctcgaccagaccaccgcggatctgccctacgaggactgcgtcggggtcacctatcaccagctgcacgaggatccggaggccgcgctcgccgagatcgtcgaccggttccacgccgtcgccgaccggtgtgacgccgtgctcgtggtgggcagcgactacaccgatgtcgccgcaccgagcgagttgtcggtgaacgcccgcatcgccgccaacctcggggcgccggtggtgctcgccgtcaaagccaagggacgcaaccccgaacaggtggcccaggtcgtcgagctgtgcgtcgacgagatcgccgcgcagcacgcccacaccgcagcggtggtggccaaccgctgcgaccccgcacagctggtcgaggtcggcgaggcgctgacgaagatcgaaccgcagagctacgtgctgcccgaggagccgctgctggtggcgccgtcggtcgccgaattgcaggccgccgtcgaaggtgctgtggtgcagggggatccggcgctcctgcaccgggaggtgctcgacgtcctggtggcgggcatgacggccgagcacgtcctcgaacggctcaccgaaggcggcgtcgtcatcaccccgggcgaccggtccgacgtcgtcctcgccgtgctcagcgcgcatgcggccgagggcttcccgtcgctgtccggggtgatcctcaacggtggcctgccgctgcacccggccatcgacggcctggtcgccggcctcgggcagcgcctgccgatcgtcgagacccggttcggcaccttcgaaaccgcgagccgtgtcgccgcgacccgcggccgggtcacgtcccagtcccatcgcaagatcgacaccgcgctgacgttgatggacacctacgtcgacactgccgaactgctcgctcacctggcactgccgatcccgtcggtggtcaccccgcagatgttcacccaccaacttcttgagcgggcgagcgcggaccggcaacgcatcgtgctgcccgagggcaacgacgaccgcatcctgcgagccgctggacggctgctgcagcgctcggtcgccgatctgacgatcctcggcgacgagagccaggtcagggcgcgcgcggcggaactcggcgtcgacctgtcccacgccgcggtgctcgatccgaagaccagcgagctgtgcgaccggttcgccgagcagtatgccgagctgcgtcaacacaagggagtgaccctcgaccgggctcgcgaggtcatccacgacgtctcctacttcggaaccatgctcgtacacaacgacatggtcgacggcatggtgtcaggggcccgccacaccaccgcgcacaccatccggcccgcgttcgagatcatccggacggcgcccggggtctcgacggtgtcgagcatcttcctgatgtgtctggccgacgaggtgctggcctacggcgattgcgcgatcgtgccggatccgaccgccgagcagctcgccgacatcgcgatctcctctgcccgcaccgccgcgcagttcggcatcgagccgcgggtcgcgatgctgtcctactcgacgggcacgtcggggaccggtgccgatgtcgacaaggtcaggcaggcaacggaactggtgcgctcccgggaaccggatctgccggtggagggaccgatccagtacgacgccgccgtggaaccgtcggtcgcccagaccaagatgcccgactcggcggtggcgggccgggccacggtgctgatcttcccggatctgaacaccggcaacaacacctacaaggccgtgcagcgcagcgccggcgcgatcgcgatcgggcccgtcctgcagggactgaacaagcccgtcaacgatctgtcacgcggtgcgctggtggaggacatcgtcaacaccgtggcgatcaccgccatccaggctcagggggttcactga

SEQ ID NO: 1624 - DNA, 2115 bp, Mycobacterium sp. MCS
atgtcgctgatgcggcaggctgtgagggtgcctgaccagaccgactcgcgggtttccgccatctacgtcgcgtcgccggagggcgacacaggaaaatccaccatcgcgctcggactgctcgaccgcctgacggcgaccgcgccccgggtcggggtgttccggcccatcacccgatcggggccggcgcgcgactacatcctcgaactgctgctcgcacactccaccgcgggtctgacgtacgaggacagcgtcggcgtcacctaccaccaattgcacgaggatcccgacagcgcactcgccgacatagtcgaccgcttccaccgcgtcgccgaccgatgcgacgtggtgctgattgtcggcagcgactacaccgacgtggcgagccccagcgagctgtcgatgaacgcgcgcatcgccgccaacctcggcgcgccggtcgtcctcgccgtcaaggcccgcgggcgcaccccagacgacgtggtgcaggtcgtcgaggtgtgtctcgacgagatcgccgcccaacacgcctacaccgccgcggtggtcgccaaccggtgcgatcccgaccagctcaccgaggtgcgcgaggcgctgaaacgtgacggcgccccgcaggtctacgtgctgcccgaggaaccgctgctggtcgcaccgtcggtcgccgaactgcgcgatgccgtcgacgggtcgatggtcagcggtgacgagtcgcttctcgaccgcgaggcgttggatgtgctggtcgccggaatgaccgccgagcacgtgctggagcggctgaccgaaggcgtcacggtcgtcacgccgggcgaccggtccgacgtggtactcgccgtcgtgagcgcccatgcggccgagggttttccgtcgctgtcgagcatcatcctcaacggcgggctggaactgcacccgtcgatcgcgaagctggtcgccgggctcgggcttcggctgccgatcgtcgccaccgggtacggcacgttcgaaaccgccagccgggtggcaggcaccagggggcgggtgactgcggcctcggtgcgcaagatcgacaccgcgctgacgctcatggagacccacgtcgacaccgcagaactgctgagccgcctggcgatcccgatccccactgtcgtcacgccgcagatgttcacctaccaactgctcgaccaggcccggtcggatcgcaaacgcatcgtgctgcccgagggggacgacgaccggatcctcaaagcggccgggcgactgctccagcgcggcgtcgcggacctcacgatcctcggcgaggagggcccggtacgggcgcgcgcggccgaactcggtgtcgacctcgcggcggcaacggtgctcgacccgcgcaccagtgagctgtgcgaccagttcgccgagcaatacgcagaactgcgcaggcacaagggcgtcaccgtcgagcaggcccgcgagatcatccacgacgtctcgtacttcggcaccatgttggtgcacaacgacatggtcgacggcatggtctccggtgccgcgcacacgacggcgcacacggtccgtccggcgttcgagatcatcaagaccctgcccgatgtgtcgacggtgtcgagcatcttcttgatgtgcctggccgaccgcgtgctcgcctacggcgactgcgcgatcgttcccgacccgacagccgaacagctggccgacatcgccatctcgtccgcgcgcaccgcggcgcagttcggcatcgagccgcgggtggcgatgctgtcctactcgacagggacctccggtaccggcgctgacgtcgaaaaggtccgcgaggcaacggacctggtgcacaagcgggaacccgacctgctcgtcgaggggccgatccagtacgacgccgcagtggaaccgtcggtcgccaagaccaagatgccggattcacccgtcgccggccgcgccaccgtgctgatcttccccgacctcaacaccggcaacaacacgtacaaggcggtgcagcgcagcgcaggggccatcgccatcggtccggtgctgcaggggctcaacaaaccggtcaacgacctgtcacgcggtgcgttggtagaggacatcgtcaacacggtcgcgatcaccgcgatccaggcccagggagatcgatga

SEQ ID NO: 1625 - DNA, 2079 bp, Mycobacterium smegmatis str. MC2 155
gtgcccgagggagaagcagccaccgcgatctacatcgcctcacccgagggcgacaccggtaagtcgacgatcgcgctgggcatcctgcaccggttggccgcgaccgtgcccaaggtcggggtgttccgccccatcacgcggctgggcgaggaccgcgactacatcctggagctgctactggcgggaaccaccgccgggttgccctacgaagactgcgtcggcgtcagctaccagcaggttcacgaggatcccgacgccgcgatcgccgagatcgtcgatcggtaccaccgcgtcgccgaccagtgcgacgcggtgctgatcgtcggcagcgactacaccgacatcgccacccccagcgaactgagcatgaacgcgcgcatcgcggtcaacctcggcgcgcccgtcgtcctcgccgtcaaggccgccgaccgcacccccgacgaggtggtccacgtcgtcgaggtgtgcctcgccgaactggccggccagcacgcacacacctcggccgtcgtcgccaaccgctgcgatccggcacagttgacggccgtgtccgaggcgctgcgcccgctcggaccgccggcctacgtgctgcccgaggagccgctgttggtggcgccgtcggttgctgagctgcagaaagccgtcgacggcacggtcgtggcgggcgatcccgcgctgctctcgcgcgaggcgctcggcgtgctggtggccggcatgaccgccgaacacgtgctggaacgcctcaccgaaggcgtcgccgtcgtcacccccggtgaccgctccgacgtggtgctcgcggtggtcagcgcccacgccgccgagggcttcccgtcgctgtcgacgatcatcctcaacggcggcctcgacctgcacccggcgatcgccaagctggtggacgggctgggcctcaagctgccgatcatcgcgacgccgtacggcacgttcgagaccgcgagccgtgtcgcatccgcgcgcggccgggtgacctcgacgtcgcagcgcaagatcgacaccgcgctgcagatcatggaacgtcacgtcgacatcgacgacctgctggcacggctgcggctgccgatccccgaggtcacgacgccgcagatgttcacctaccagctgctagaccgggcccgcgccgaccgcaagcgcatcgtgctgcccgaaggcgacgacgaccgcatcctcaaggccgcgggacggctgctgcggcgcggtgtcgccgatctgaccatcctcggcgaggagaaccagatccgttcccgcggcgcggaactcggtgtcgacctatcggcggcgaccgtgctcgacccgcgcaccagcgacctgtgcgaggcgttcgcgcagcagtacgccgagttgcgcaagcacaagggcatcacgctggaccaggcccgcgagatcatcgtcgacgtgtcctacttcggcaccatgctggtgcacaacgacatggtcgacggcatggtctccggcgccgcacacaccaccgcccacacggtgcggcccgcgttcgagatcatcaagaccctcccggacgtgtcgaccgtgtccagcatctttttgatgtgcctggaggatcgcgtactcgcctacggcgactgcgcgatcgtgccggatcccacggccgagcaactggccgacatcgcgatctcgtcggcgcgcaccgcggcacagttcggcatcgaaccgcgcgtcgcgatgctctcgtactcgaccggcacctcgggtaccggcgctgacgtcgagaaggtcaaggcggcaacagatctggtgcgtgagagggacaagacgttgctcgtggaagggcccatccaatacgacgcggcggtcgaaccgtcggtggccaagaccaagatgcccgattcggaggtggcggggcgcgcgaccgtgctgatcttccccgacctcaacaccggcaacaacacgtacaaggccgtacagcgcagcgccggtgcgattgcgatcggccctgtgctgcaagggctcaacaagcccgtcaacgatctgtcccgaggcgcgctggtggaggacatcgtcaacaccgtcgccatcaccgcgatccaggcgcagggccggtcgtga

SEQ ID NO: 1626 - DNA, 2082 bp, Mycobacterium abscessus
atgacccagcccaaggcatcgagtatttatattgcctcgcccgaaggggacaccggaaagtccacggtggccctgggcgtaatgcatcggctggccgcgtcggtggcgcgtgtgggtgtgttccgccccatcgcgcggtccggggaaagcgtggactacatcctggaattgctgttggagcagagtactgccgatatcgcgtatgaggactgccttggtgtctcgtaccacgacgtccatcaggacccggatgcggcaatcgcccagatcgtggacagatatcacgcggtcgcggagcgctgcgacgctgtggtgatcgtcggtagtgactacaccgatgtcgcgagccccagcgagctgggcaccaatgcccgcatcgcggtcaacctcggcgcaccggtcctgttgaccatcaagggattcgatcggacgcccgacgaggtggcggcgctggccgaggtctgtctgggcgagctcaaggcgcagcgcgcacacaccgccgctatcgtcgccaaccgctgcaaccccggccaactggacgaggtgcgccaggccctggcgcggttcgataagccggcctgggtgttgcccgaggtaccgctgttggtctcgccgtcggtcgaggaactcatgaaagcggtcaaagggtccctggtcagtggtgacgaggcactgctctcccgcgaggccaccagcttcatggtcgcgggcatgacagcagaacattgcctggagcggctcaaggagggccaggccgtcatcttccccgcggaccgctcggacgtactactcgccgtggcaagtgcgcatgtggcagaaggctttccgtcgctatcggccatcatcttgaatggtgggctcaagctgcacccgcgcatcgcagatctggtggacggtatcgggctgcggttgccgatcatcgagacggactccggcaccttcgagaccgcgagcgcggccgcgcatgcgcgtggccgggtgacggtggcttctgcgcgcaagatcgataccgcgctcgcgctgatggacaggtacgtggatggcgcggatctcgttgcgcagctcgctatcccgataccgtcggttaccacgccgcagatgttcgagtaccagctgctggaccgggcacgcgacaaccgcaagcgcatcgtgttgcccgagggcgacgacgacaggattctcaaggccgccggccggctattgcagcgtcaggtcgccgacctgacgatcctgggcgaagaggccgaaatccgctcccgtgccgccgagctcggtgtcgacatctcgaacgcgctcgttgtcagtcccaagaccagcgatctggccgagaagttcgcggaccagtacttcgagctgcgtaagcacaagggcatgacgcccgatcgggcacgtgaaatcatgcgtaacgtctcgtatttcggcaccatgctggtgtacaacgacatcgtcgatggcatggtctccggtgcggcgcacaccaccgcgcatacgattaggccggcgttcgaagtcataaggacgacgtccggtgtttccacggtgtccagcatcttcctgatgtgcctggccgatcgggtgctggcgtacggagactgcgccatcgtgcccgatccaacctccgagcagctggccgatatcgccatctcgtcggcgcggaccgccgcgcagttcggcatcgatccccgggtggcgatgctgtcctactccaccgggtcgtcgggaagcggcgcggatgtggaaaaggtgcgtatcgcaacggagttggttcgttcgcggcaacccgagctgctcgtcgaggggcccatccaatacgacgcggcggtcgagccgtcggtggcggccaccaagatgcccgattccccggtggcgggccgtgcgacggtgctgattttccccgacctcaataccgggaacaacacctacaaggcggtgcaacgcagcgccggtgccgtcgccatcggacccgtgctgcaggggctgcgtaagcccatcaacgacctttcacgcggggcgttggtggaggacatcgtcaacaccgtggccatcaccgcaatccaggcacaggaaaggaaacaatcgtga

SEQ ID NO: 1627 - DNA, 2091 bp, Mycobacterium kansasii ATCC 12478
gtgtcctccagctccccgggtaccactgcgatctacatcgctgcgcccgaaccggcaagcggcaaggcgaccatcgcgctggggatcctgcaccggttgacggcgacggttgccaaagtcggtgtgttccggccacttacgcgggcatccggggcgcgcgactatctcctggagctgctgctcgagcacaccaccgccggcctgccctacgagcaatgcgtgggcgtgacctaccaatacctgcacgccgacaccgataccgcgatcaccgacatcgtcgccgcgtatcacgcgatggcgcacaagtgcgacgcggtggtgatcgtcggcagcgactacaccgacgtcgccacccccaccgaactgtcggtcaacgcccggatcgcggtcaacctcggcgtgccggtgttgttggcggtcaacgccaaaggccgcaccgccgaccaggtggtcagcgtcgtcggggtgtgtctggccgagctgtcggcccaccacgcacacaccgcggcggtggtggccaaccgttgcgagcccgcggaattggcggccatccgcgaagcgctgcgcatcgtcggtccgccaagctacgcgctgcccgaggagccgctgctgtcggcgccgacggtggccgaattggaaagggccgtcgacgggacggcgatcagcggtgaggcgccgctgcgcaatcgcgaggtgatggacgtgctggtggccgggatgaccgccgatcacgtgctggagcggctgggcgaaggcatggcggtgatcaccccgggcgaccgctcggacgtggtgctcgccgtcgccagcgcccatgcggccgaagggtttccgtcgctgtcgtgcatcgtgctcaacggtgggttcgacctgcatccgtcgatcgcggcgctggtgtcggggctgcggctgaggttgccgattatcgccaccacgttgggtacctacgagacggccagcgccgccgcggcggctcgcggccggctcaccgcaacctcgcagcgcaagatcgacaccgcgctggagctgatggaccgccacgtcgacaccgccgatttgatgacccaccttgccattccgatcccgaccgtgacaacaccgcagatgttcacctatggcttgcagcaacgcgcgcgttcgaaccgcaaacacatcgtgcttcccgagggcgacgacgaccgcatcctcaagtccgccggccgcctgctgcaacgcggcatcgccgagctgacgatactgggcgacgaggcccggatccgggcgcgcgcagccgaactcggcgtggatctgggccaggcaaaggtgctcgacccgcgtaccagcccgctgtgcgaccacttcgccgagcaatatgccgaattgcggaagtcgcacggcatcaccgccgagctggcacgtgaaatcatgtgtgacgtatcgtatttcggcaccatgctggtttacaattcccacgtcgacggcatggtgtccggagctgcccataccaccgcgcacaccgttcgtcccgccctggaaatcatcagaacggccccaggtatctcgacggtgtccagcatctttctgatgtgcctgcccgatcgggtgttggcctacggcgactgcgcgatcgtgccgaacccgacgcccgagcagttggccgatatcgcgatctgctcggcgcgcaccgccgcgcagttcggcatcgaaccgcgggtggccatgctgtcctactccaccggagcctcagggaccggagccgacgtcgaaaaggtcagggaggcaacggagttggtgcgctcacgggagccgcagctgctggtggaggggcccatccaatacgacgccgcagtcgaccccgcggtcgcggccgccaagatgcatgattcgccggtggccggccgggcgacggtgctgatctttcccgacctcaacaccggcaacaacacctacaaggcggtgcagcgttcggcgggagccatcgcgatcggcccggtgctgcagggcctgcgcaagccggtgaacgatttgtcgcgcggggcgctgatcgaggacatcgtcaacacggttgccattaccgcgatccaggcgcaggggatcggcgatgaccggtag

SEQ ID NO: 1628 - DNA, 2085 bp, Mycobacterium marinum M
gtgtcgaccggctcgggcgccaccggcatatacatcgccgccccggaaccggagagcggcaagtcaaccattgccctgggtatcctgcacagattggccgccaccgtggccaaggtcggtgtgttccggccgatcacccgccgcggcgagcggcgtgactacattctcgaattgctgctggagcagaccactgccggactgtcctacgagcaatgcgtcggcgtcacctaccaacagctgcacgacgacctcgaagccgcgatagcggacatcgtcgccgcctaccacgcgatggccgatgcgtgcgacgcggtggtgatcgtcggcagcgactacaccgacgtcactacgcccaccgagctgtcggtcaacgcgcgcatcgcggtcaacctcggagccccggtgctgctggccgtgagcgcaaaaggccgtgacgcggatcaggtctccggagtcgtcgcggtgtgcctggccgagctggccgcacagcacgcccacaccgcggccgtggtggccaaccgatgtgagcccgcgcagttggcggccgtcggtgatgcgttgcgggccttcgccccgcccagctatgtgctgcccgaagaacagttgttgtccgcgccgacggtgtccgagttggagaagtccgtcaacggaacaccgatcagtggcgatgcctcgctgtggggccgggaggtcaccagcctgctggtcgccgggatgaccgccgatcatgtgctggagcggctgcgcgacggcatggccgtgataactcccggtgaccgctccgatgtggtgctcgccgtggccagtgcccatgcggccgagggctttccatcgctttcctgcatcgtcctcaatggcgggttcgagttgcacccgtcgatcgcctcgctggttgccgggctgcggctgcgactgcccatcatcggaaccgatctgggcacctttgacaccgccagcgctgccgcgacggctcgcggccgggtcaaggcgacgtcgcagcgcaagatcgacaccgctctgggattgatggaccgctacgttgacatcgaggatctgttggcgaagcttgcgatcccgatcccgacggtcaccacaccgcagatgttcatgtaccgcgtgcagcagcaggcgcgttcggatcgccagcgcatcgtcttgcccgaaggtgaagacgaccggattctcaaatccgctgggcggctattgcagcgcaacgttgccgatttgaccattctcggtgacgaggccgaaatccgtttgcgtgcggctgaactcggagtcagcctggatagcgccacggtgatcgacccgcgtaccagtagcttgtgcaacgagttcgccgatcagtatgcgcagctgcgtaaggccaaggggatcacccacgagcaggcccgcgagatcatgaacgacgcaacctatttcggtaccatgctggtatacaacggcatggccgacggcatggtttccggcgccgcacataccacggcccacacggttcgccccgcgctgcagatcatcagaaccgttccgggcgtgtccaccgtctccagcatcttcttgatgtgcctgcccgatcgggtgctggcctacggtgactgcgcgatcatcccgaacccgaccgtcgaggagctggccgatatcgctgtctgttcggcgcgcaccgccgcgcagttcggcgtcgagccgcgagtggccatgctctcctactccaccggcgcatcaggatccggggcggacgtcgacaaggtaagagcggcaaccgaactagtgcgcgaaagggatccgcagctaatggtggaaggccccatccagtacgacgccgcggtggacctgtcggtcgcggctaccaaaatgcgcgattctgcggttgccggccgggcgacggtgctgatcttcccggatctcaacaccggcaacaacacctataaggcggtgcagcgcagcgccggtgcggtggcgatcggcccggtactgcagggcctgcgcaagccggtcaacgacttgtcccggggtgctctggtggaggacattgtcaacaccgtcgctatcaccgcaattcaagctcagggtgttcatgagcgctag

SEQ ID NO: 1629 - DNA, 2073 bp, Mycobacterium tuberculosis H37Rv
ttggctgactcctcggcgatctacctcgccgcaccagaatcgcagacgggtaagtcgacgattgcactggggcttttgcaccgactgaccgcgatggtcgccaaagtcggtgtgttccggccgattacgcggctctctgcggagcgggactacatcctggaactactgctcgcgcacaccagtgcgggcctgccctatgagcggtgtgttggcgtgacctaccagcagctgcatgctgaccgcgacgacgcgatcgccgaaattgtcgattcgtatcacgcaatggccgacgagtgtgacgcggtggtggtcgtcggcagtgactacaccgacgtcaccagccccaccgagctctcggtcaacggccggatcgcggtgaacctcggcgcgccagtgttgttgacggttcgggcgaaggaccgcacccccgatcaggtcgccagcgtcgtcgaggtctgcttggccgagctggacacccagcgcgctcataccgcggcggtagtggcgaaccggtgcgagctgtccgcgataccggccgtgaccgacgcgctgcgcaggttcaccccgcctagctatgtagtgcccgaggaaccactgctgtcggcgccgaccgttgccgagttaacgcaggctgtgaacggggcggtggtaagcggtgatgttgcgctgcgcgaacgtgaggtgatgggcgtgctggccgcgggtatgaccgccgaccatgtgttggagcggctgaccgatggcatggcggtgattactcccggcgaccgctcggacgtggtgttggccgtcgctagcgcccatgcggccgaagggtttccgtcattgtcatgcatcgtcctcaatggcgggttccagttgcatccggcgatcgccgccctggtttccggcctgcgattgcggttacctgtcatcgccaccgcgttgggcacctacgacaccgccagcgctgccgcgtcggcccgcgggctggtaacggcgacgtcgcaacgcaagatcgacaccgcgttggagctgatggaccgccacgtggacgtcgccggtctattggcgcagctgaccattcccatccctacggtcactacaccacagatgttcacttatcggctgctgcagcaggcccgttcggacctcatgcgcatcgtccttcccgaaggggacgacgatcgcatcctcaaatcggcgggccgcctgcttcagcgcggcatcgtcgacctgaccatcctgggcgatgaagccaaagtccgtctgcgggcagcggaactcggtgtggacctggacggcgccacggtaatcgagccatgcgcaagcgaactgcacgatcaattcgccgaccagtatgcgcagttgcgtaaggcgaagggaatcaccgtggagcatgcccgcgaaatcatgaacgatgccacatatttcggcaccatgctggtgcacaactgtcatgccgacggcatggtatcgggtgctgctcacaccacggcgcacaccgttcgtccggcgctggagatcatcaagaccgttccgggcatatccaccgtgtccagcattttcctgatgtgtctgccggatcgggtactggcgtacggcgactgcgcgatcatcccgaacccgacggtggagcagctcgctgatatcgccatctgctcggcacgcaccgccgcacagttcggcatcgagccccgggtggccatgctgtcctactccaccggtgactcggggaaaggtgccgacgtcgacaaggtcagagcggcaacggagttggtgcgcgctcgggagccgcagctgccggtcgagggtcccattcaatacgacgccgcagtggaaccgtcggtcgcggccaccaagttgcgcgattcgccggtggccggccgcgcgacggtgctgatcttccccgatctcaataccggcaacaacacctacaaagcggtgcagcgttctgcgggtgcgatcgcgatcggcccggtgctgcagggcttacgcaagccggtgaacgacctatctcggggtgcactggtcgacgacatagtcaacaccgtggccatcacggcgattcaggcgcagggcgtccatgagtag

SEQ ID NO: 1630 - DNA, 2088 bp, Mycobacterium avium subsp. paratuberculosis K-10
ttggctgacatttcggcgatctacgttgccgctcccgaaccggagaccggcaagtccaccgtcgcgctgggcctgctgcaccggctgaccgcgacggtcgccaaagtcggtgtgtttaggccgattacgcgtgacgggcaggaccgcgactacatcttggagctgctgctgtcgcgcaccaccgcggggctgtcctaccagcagtgcgtcggcgtcacctaccaacagctgcacgccgacggcgacgcggcgatcgccacgatcgtcgacgcctaccacgcgatggccgagctgtgcgacgtggtggtcatcgtcggcagcgactattccgaactgggacaggcgatccggcccgcggagctgtccaccaacgcccggatcgcggtcaacctcggtgcgccgatcctgctgacggtcagcggcaaggggcgcaccgccgccgaggtcgccaccgtcgtgcaggtctgcctggccgagctggacgcccagcacgcgcacaccgcggcggtggtggtcaaccggtgcgagccggccgagctggacgcggtggccgaagcgttgcgcggctttccccagcgctgctacgtgctgcccgacgagccgctgctgtcggcgccgacggtggccgaactggaaaaggcggtcgccggttcgccggtcagcggcgaggagtcgctgcgcgagcgcgaggtcaccggcatcctggtcgccgggatgaccgccgaccacgtgctggagcgcctcgcggacggcatggccgtcatcacccccggcgaccgctccgacgtggtgctcgccgtggccagcgcccatgccgccgaaggctttccgtcgctgtcgtgcatcgtgctcaacggcgggttcgcgctgcatccgtccatcgcggcgctggtggccgggctgcggctgcggctgcccatcgtcgccaccgcgctgggcacctacgacaccgccagtgcggcggccgcggcccgcggcagggtgacggccacctcacagcgcaagatcgacaccgcgctggagctgatggaccggcacgtcgacatcgcggatctgcttgaacagcttgccattccgattcccaccgtgaccacgccgcagatgttcatccatcagctgaccctgcaggcgcgcgcggaccgcaagcacatcgtgctgcccgagggcgacgacgaccgcatcctgcgcgccgccggcagggtgctgcagcgccgcgtcgccgacctgaccatcctgggcgacgaggcccggatccggcagcgctcgggggaactcggggtggacctgagcgacgtgaaggtcatcgacccgcgcaccagcgcgctgcgccccgagttcgcgcagcagtacgcgcagctgcgcaaggccaagggcgtcaccgtcgagcaggcccgcgaaatcatgcgcgacgcaacgtacttcggcaccatgctggtgtacacctcccaggtcgacgggatggtgtccggcgccgcccacaccaccgcacacaccgtgcgcccggccttcgagatcatcaagacggtgccggacgtctccaccgtgtccagcatcttcctgatgtgtctgcccgaccgggtacttgcctacggcgactgcgcgatcatccccaacccgacaccggagcagctggccgacatcgcgatctcctcggcgcgcaccgccgcccagttcggcatcgaaccgcgggtggccatgctgtcctactcgacgggtgactccggcaccggagccgacgtcgaaaaggtaagaacggcaacgcaattggtgcggcagcgcaaccccgacctgccggtcgagggccccatccaatacgacgccgccatcgaaccgtcggtcgccgccaccaagctgcgggattcgccggtggccggtcgggccaccgtgttgatctttcccgacctcaacaccggcaacaacacctacaaggcggtacagcgcagcgccggcgcgctggccatcgggccggtactgcagggcctgcgcaagccggtcaacgacctgtcgcggggtgcgctggtcgaagacatcgtgaacaccattgccatcaccgcgattcaggcgcaggggttgcccggtggacggtag

SEQ ID NO: 1631 - DNA, 2160 bp, Mycobacterium intracellulare ATCC 13950
gtggtctcgggcgccgcaacggcgatctacatcgccgcgcccgagccggagaccggaaagtcgacgatcgcgctgggcctcctgcaccggctgaccgcgacggtggcgaaagtcggtgtgttccggcccattacgcgttcagatggcggcgatcgccaacgcggcgaagccgggcgcagcgggtcgccgcaggacctggaaaatcgcgactacatcctggaactgctgctgtcgcgcaccacggcgggcctgtcgtacgagcaatgcgtcggcgtcacctaccagcagctgcacgcggacggcgacgcggcgatcgccgccatcgtcgacgcctaccacgccgtcgccgagaagtgcgacgtcgtggtgatcgtcggcagcgattattccgaactcggacaggcgattcgacccgcggagctttccaccaacgcgcgcatcgcggtcaacctcggcgcgccgctgctgctgacggtcagcggcaagggccgcaccgccggtgaggtggccgacgtcgtcaaggtgtgcctggccgagctggacgctcagcacgcccacaccgcggcggtggtggccaaccgctgcgaaccggccgagctggacgccatccggaagaagttggacgaggcgctgcggccgtcgtccctgcgcagctacgtcctgcccgacgaaccgctgttgtcggcgccgacggtggccgagcttcagagcgcggtgcgcgggacgccggtcagcggcgaagagtcgctgcgcgaacgcgaggtcaccggtgtgatggtggccgggatgaccgccgaccacgtcctggaacggctgcgcgacggcatggcggtcatcacccccggcgaccgctcggacgtggtgctcgccgtcgcgagcgcccatgccgcggaagggtttccgtccctgtcgtgcatcgtcctcaacggcggcttcgagctgcacccgtccatcgcggccctggtcgccgggctgcggctgcggctgccgatcgtcgccaccgcgctgggcacctacgacaccgccagcgcggcggccaccgcccggggcagggtcacggcggcgtcgcaacgcaagatcgacaccgcggtcgagctgatggacggccacgtcgacatcaccgatctgctggcgcagcttgccattccgatccccaccgtgaccacgccgcagatgttcatccatcagctgaccctgcaggcgcgttcggatcgcaggcacatcgtgctgcccgagggcgacgacgaccgcatcctgcgctcggccgggcgggtgctgcaacgccgcgtcgccgacctgaccatcctcggcgacgaggcccaaatccgccagcgcgcgggcgaactcggggtggacctggccgacgtgacggtgatcgatccgcgcgccagccggctgcgcgacgagttcgccgaccagtatgcgcagttgcgcaaggcgaagggggtcaccgtcgagcaggcccgcgagatcatgcgcgacacaacgtacttcggcaccatgatggtgcacaacgggatggtcgacggcatggtgtcaggcgccgcccacaccaccgcgcacaccgtgcggcccgcgttcgagatcatcaagaccgtcccggacgtgtccaccgtgtccagcatcttcctgatgtgcctgcccgatcgtgtcctggcctacggcgattgcgcgatcatccccaatccgacaccggagcagctggccgacatcgcaatctcctcggcgcgcaccgccgcacaattcggcatcgaaccgcgggtcgcgatgctgtcctactcgaccggcgactccggctccggtgccgacgtcgacaaggtcagaacggcaacgcaattggtgcgagagcgcaaccccgacctgccggtggagggccccatccagtacgacgcggcgatcgaaccgtcggtcgcggccaccaagctgcgcgactcgccggtggccgggcgcgccacggtgctgatcttccccgacctcaacaccggcaacaacacctacaaggcggtccagcgcagcgccggagccctcgccatcggacccgtgctgcagggtctgcgcaagccggtgaacgacctgtcgcggggcgcgctggtcgaggacatcgtgaacaccgttgccatcaccgcgattcaggcacaaggcggccccgatgggaagtag

SEQ ID NO: 1632 - DNA, 2079 bp, Rhodococcus erythropolis PR4
atgccagaagcgcccgctgccgtgtcgagtgtctacgtcgcctcccctgaaggtgacaccggaaaatccaccatcgcgcttggcgtgctgcagatgctgtgcgcgaccgtcgcccgggtcggtgtcttccgcccgatcgcccgctcgaccgaggaaaccgactacatcctcgaactgctgctagagcacaccactgccgatctctcctacgccgacgcactcggcgtcacctacgagcaggttcacgccgatcccgaagctgcactggccgacatcgtggcgaagtaccacaccgtggccgagcagtgcgacgccgtcgtgatcatcggaagtgactacaccgacgtcgcaagccccagcgaactgagcttcaacgcccgcatcgccgtgaacctgggagcgccggtcctgttggcggttcgaggcgctcggcgcagcgtcgaggaggttgctcagctcgcgcacctgtgcgccgccgagttggccgccaaccacgctcacctgctcgcggtcgtcgccaatcgctgcgatcccgacaagctcgacgaggtcaccgcagccctgtccgacatcggtgttccgacgtggagcctgccggagattccgttgctcgtctcacccacgatggccgagttgatggaagccaccggcggcgagttgtactcgggtgacccggaactgctgcaccgcgaggcactgaaggtgatggtgggcggaatgaccgccgagcacatcctcgagcgtctggtcgagggcatggtcgtcatcgcaccgggtgaccgctcggacgtgctgctcgcgttgctcaatgcgcatgaggcggagggatttccgtcgctcgcgggcatcatcatgaatggcgggatcacgccgcacccggccatcgcggcgttgatggccggcctcaaacagcgtcttccgatcctcacgacaaccctcggcactttcgacaccgcaagcgctgcagcccaaacccgcggacgcgtggcagtcggttcgcagcgaaaggtcgacactgcgctgagcttgatggaacagcgcgtcgacgccgacgtcctgatggaccgactggcactgccgattccgtcggtcgtgaccccacagatgttcgagtacaagctcatcgaccgcgctcgacgcgatcgcaagcacatcgtcctcccggagggtgacgacgaccggatcctgcgcgcggccggccggctgctgcagcgccaggttgccgacctgacgatcctcggcgacgaacccagtgtgcgtcgacgcgcagcggaactcggcgtggacatcagcggcgcgcaggtcctcgcgcccgcgcagtccgagtacaccgagcgcttcgcgcaggaatacaccgcgctgcgggcgcacaagggcatgaccatcgagcgggcacgcgaggtgatcgccgacatctcgtacttcggaacgatgatggtgcacttgggtattgccgacggcatggtctccggtgccgcccacaccaccgctcacacgatccggccctcgttcgagatcatcaagacggcccccggagtttcgacggtttcgagcatcttcctgatgtgcctggccgaccgcgttctctcctacggtgactgcgccgtggttccggacccgacgtcggagcagttggcggacatcgcgatctcgtccgcacagacggcgtcgcagttcggtatcgatccgcgcattgcgatgctctcgtactccaccggcgattcgggcagtggagccgacgtcgacaaggttcgcaccgcgaccgctttggtgcgcgagcgccgaccggacctgttggtggaagggcccattcagtacgacgcggccgtcgagcagagtgtcgctgacaagaagatgccggattctctggtggcgggcaaggccacggtgttcgtgttcccggacttgaacaccggcaacaacacctacaaggcagtgcagcgtagcgccggcgctatcgccgtcggcccggttctgcagggactgaacaagccggtcaacgatctctcgcgtggagcgttggtccaggacatcgtcaacaccgtggctatcacggcaatacaggcacagggagcgtaa

SEQ ID NO: 1633 - DNA, 2121 bp, Rhodococcus jostii RHA1
atggccatggctgcgccagcgacaccctcacccgtgaatccgcccgcccgatcccagccctcgagcgtttacatcgcctcaccggagggggacaccggcaagtccaccatcgcgctgggtgtcctgcagatgctctgtgcgtcggcggcgagggtgggcgtcttccgtcccatcgcccgatcgacgcaggaaaccgactacatcctcgagttgctgctcgaacacacgacggccgacgtcggctacgaggaggccctcggggtcacgtacgagcatgtccacgccgatcccgacggggcgctcagcgagatcgtctcccggtatcaccaggtggcggcgcagtgcgacgccgtcgtggtgatcggcagcgattacaccgacgtggcgagcccgagcgaactcggttacaacgcgaggatcgccgccaacctgggcgcaccggtgctgctcgccgtgaagggagcgcggcgcacccccgaggaggtcgcgcaactcgcccatctcgcgatcggtgaactgacttctcaccacgcccatccgctcgctgtggtcgcgaaccgctgcgacccggatgagctcgatgcggtcaccgccgcgttggcgtccaccggtgtgcccgcgtggagcctgcccgagatcccgctgctggtcgcgccgaccatggccgaactcctcgagtcgatcgacggcagcctgttcagcggcgaccccgagcttctccaccgcgaggcgctgcgggtaatggtgggcggaatgacggcggagcacattctcgaacggttgaccgagggcacggtggtgatcgccccggccgaccgttccgacgtgctgctggcgatggtgaatgcgcatgaagccgaaggtttcccgtcgctggcgggcatcatcatgaacggcggcctgatgccgcacccggcgatcgcgaagctgatggccggcctgaagccgcggttgccgatcctcaccaccggactgggcacgttcgacacggccagtgcggccgcgcagacccgtggccgggtggcggtcggttcgcagcgcaagatcgacaccgccctgagcgtcatggaactgcgggtggacgcacccacactgctggagcgcttgaagttgccgatcccctcggtggtgactccgcagatgttcgaataccagctgatcgaccgtgcccgccgcgaccgcaagcacatcgtgctgccggaaggcgacgacgaccgcatcctccgcgcggcggggagactgttgcagcggcaggtggcggcgctgaccattctcggcgacgaggtgcaggtgcggcgccgcgcggcggaactcggcgtcgacctcggtgacgcacaggttctcgacccccggacgtccgaccacgccgggccgttcgccgaggagtacgcgcggctccgcgcccacaagggcatgaccgtggagcgggcccgcgaggtgatggccgacatctcgtacttcggaaccatgatggtgcacttgggaatcgcggacggcatggtctccggtgccgcgcacaccacggcgcacaccatccggccgtcgttcgagatcatcaagacgcaaccgggggtgtccacggtgtcgagcgtgttcctgatgtgcctgtccgatcgggtactcgcgtacggggactgcgcggtggtgcccgaccccaccgccgaacagttggccgacatcgcgatctcgtcggcgcagacggcggctcagttcggcatcgatccgcggatcgcgatgctgtcgtactcgaccggcgactccgggagcggcgcggacgtcgacaaggtgcgctccgcgacgaaactcgtccgcgagcgtcgcccggacctgttggtggagggccccattcagtacgacgccgccatcgagcagagtgtggccgacaagaagatgcccgattcggcggtggccgggaaggcgacggtcttcatcttccccgacctcaacaccgggaacaacacctacaaggccgtgcagcgcagtgccggcgccatcgccgtcggtccggtgttgcagggcctcaacaagcccgtcaacgacctgtcgcgaggggcgctggtcgaggacatcgtgaacaccgtggccatcaccgcgatccaggcgcagggagcagagaagtga

SEQ ID NO: 1634 - DNA, 2088 bp, Nocardia farcinica IFM 10152
atggtcgaatccgctccgtccaccgtgtacatcgcctccccggaaggagacaccgggaagtcgacggtcgcgctcggcgtcctgcagatgctgtgcgccaccacggcgcgagtcggggtgttccggccgatcgcgcgctcgaccaccgaacccgactacatcctcgaactgctgctcgagcacagcaccgccgatctggactacgcccagtccatcggcgtcacctacgaacaggtgcacgccgaccccgacgccgccatcagcgagatcgtcatgcgcttccacgaggtcgccgacgcctgcgacgcggtggtggtgatcggcagcgactacaccgatgtcgccagcccgagcgagctgcgcttcaacgccaggatcgcggtgaacctcggcgcgccggtgctgctggtggtgcgcggctccggccgcaccccggtggaggtcaagcagctggtcgaactgtgcatgagcgagttgcacgccgagcacgccgccgccgtcgcggtgatcgccaaccgttgcgatcccgaccagctcgacgacgtgtgttcggtcctcggcgcgttcgacgtcccgtcctgggcgctgccggaggtgccgttgctgatcgcgccgacgatggccgagctgtgcgaggcggtgggcggcgagatgtacagcggcgacccggaactgttgcagcgcgaggcgctgaagatcatggtcggtggcatgaccgccgagcacattctggagcggctggtcgacggcgtggtcgtgatcgcaccgggcgaccggtccgacgtgttgctcagcgtggtgaacgcccatgaggccgagggcttcccgtcgctgtcgggcatcatcatgaacggcgggatgcgcccgcaccccgcggtcgcccggctgatggccggtctcaagccccggctgccgatcctcaccaccgacctgggcacctacgacaccgccagcgccgcctaccgcaccagggggcggatgtcggcgggcaacccccgcaaggtcaacaccgcgctggcgctgatggaacagcacgtcgacgcgccggaactgctgagccgcatccgcgttcgccgcagcgacgtggtgaccccgcagatgttcgaataccagctcatcgagcgggccagggccgaccgcaagcgcatcgtgctgcccgagggcgacgacgaccgcatcctgcgcgccgcgggccgggtgctccagcgcaagatcgccgacctggtcatcctcggcgacgagaccgcgatccgggcgcgcgccgccgaactcggcgtcgacatcgccgaggccgaggtgctcgatccgcgcacctccgggcacctggagtcgttcgccgccacctacaccgaactgcgcaagcacaagggcatgacgctggaacgcgcgcgcgaaaccgtcgccgacatctcctatttcggcaccatgatggtgtacgagggcatcgccgacggcatggtttccggcgccgcgcacaccaccgcccataccatccggccctccttcgagatcatcaagaccgtgccgggggtgcagacggtctccagtgtgttcctcatgtgcctggccgaccgggtactcgcctacggcgactgtgccgtggtgcccgatcccacctccgagcagctcgccgacatcgccatctcctccgcccgcaccgcccagcgcttcggcatcgacccgcgggtggcgatgctgtcgtattcgaccggcgagtccggcagcggcgcggacgtggagaaggtgcgggtggccaccgatctggtgcgcgagcgcgcgccggaactgctggtggagggcccgatccagtacgacgcggcgatcgagcccaccgtcgccgacgcgaaactgcccgactccgaggtcgccgggcgcgccaccgtgttcgtcttccccgatctcaacaccggcaacaacacctacaaggccgtgcagcgcagcgcgggcgccatcgcgatcggcccggtgttgcagggcctgcgcaagccggtcaacgatctctcccgtggcgcgctggtcgccgacatcgtcaacaccgtggccatcaccgccatccaggcgcagggcatcgcggaacaggagggctga

SEQ ID NO: 1635 - DNA, 2130 bp, Tsukamurella paurometabola DSM 20162
atggtcgcgagcccgaaaacgagcagcatctacatagcctcccccgagggagataccgggaagtcgaccatcgcgctcggcgcgatgaatctgctcacctccacggggtggacgatcggcgtcttccgcccgatcccccgcacctggggtgagcagcgcgattacattctggaactgctcatcgagcaggccaccgcggatctcgactacgacgactgcgtgggcgtctcctacgagaaggtgcacgaggaccccgacgccgcgatcgccgagatcgtcagccggtatcacgccgtggccgacaagtgcgatttcgtgttgatcctgggctccgattacacggacgtcagttcgcccaccgagctgtcgttcaacgcacggatcgccgccaacctgggcgcgtcgatcctgctcgcggtcaaggccctcgaccgcacgcccgagcaggtggtctccgtcgccgagcagtcgatggccgagatccgggcgaaccacgcgcacacctcgtcggtgatcgccaaccgctgcgaccccggccagctcgacgcggtgcgccaggcactcgcgacggccaccgggctgccggtgtgggtgcttcccgaggagcccgtgctcaccgcgcccaccgtcggcgaactgatggaggccatggacggcaagttgctctggggtgatccggagttgctctcccgcgaggcgatggacgtgctcgtggccgggatgaccgccgagcacagcctggagcgagtcaccgagggcgtcgcggtgatcgcgcccggtgaccggtccgaggtgttgctcgccatggtgaacgcgcaccgcgccaacggcttcccgtcactggccgggatcatcctcaacggtgggtacgcgccgcacccgatgaccgcggcgctggtcgatggtttgaagccgacactgccgatcgtcgccgtgcagcagggcacctacgaatccgcgcggatcgcggccaagacccgcggccgggtgggccccggatcggcccgcaaggtggacctcgccgtcgccctcaccgagcggtacgtggtctccgaggatctgatggaggcgctgcaggtctccaaccccggtgtagtcaccccgcagatgttcgagtaccacctgatcgcccgcgcccgggcggaccgcaaacggatcgtgctccccgagggcgacgacgaccggatcctccgcgccgccggccggctgctccagcgcgaggtggccgatctgaccatcctcggtcaggaatcccgcgtgcgcgcccgagccgccgaactgggggtggatctgggcgacaccgatgtgatcgatccgaaacgggccaccgacctcatcgacaagttcgcgcagacctactacgaactgcgcaagcacaagggcatgacgctggagcgcgccgccgagaccgtggtcgatgtgagctatttcggcaccatgatggtgtacctcggtatggccgacggcatggtctccggtgccgcgcacaccacggcccacaccatccgcccctcgttcgagatcatcaagaccaagcccggcgtctcgacggtctcgtcgatcttcctgatgtgcctggccgacaaggtgctcgcctacggcgactgcgccgttgtgcccgatcccaccgagacccagttggccgatatcgcgatctcctcggcgcagacggcgtcccagttcgggatcgacccgagggtggcgatgctgtcctactcgaccggcgaatccggcaccggcgccgatgtcgataaggtacgtgccgccaccggactggtccgcgagcgtgccccgaaactactggtggaggggccgattcagtacgacgccgccgtcgacccgggcgtcgcggcctcgaagatgcccgactccgcagtggcgggcaaggcgacggtgctcgtgttccccgacctcaacacgggcaacaacacctacaaggccgtgcagcgatcggcgggcgccgtcgccatcggtccggtgctgcaggggctcaacgctccgatcaacgacctgtcccgcggcgccctggtggaggacatcgtgaacaccgtggcgatcaccgcgatccaggcacaggccttcgcggcggagaaggcggggaaggccgacgcgaaggagacgcaggcatga

SEQ ID NO: 1636 - DNA, 2121 bp, Gordonia bronchialis DSM 43247
atggccagcgacaccgacgccgacaccgccaacgacaccccgaccttgcacagcatctacatcgcctccgccgaaggggacaccggaaagtcgacggtcgcgctgggcctgctcgccctgctcaccgccacgggcggacgggtcggtgtcttccggcccatctcgcgggcggcggccggcgagcgtgactacatcctcgacctcctcatcgagcacgactcggtggacatcgactacgacgactgcatcggcgtgacctacgaccaggtacacgaggaccccgagggcgcgatcggcgagatcgtcgcccgcttccacgcggtcgaggcccgctgcgaccgcgtgctggtgatcggatccgactacaccgacgtcggcaacccgtcggagttgagcttcaacgcccgcatcgccgccaacctctcggccccgatcatcttggcgctcaaggccgccggacgaacaccgcaggaagtgcacggtctggccgagctgctgatggctgagatcgcggcgtcacatgcgacgacgatcgcgctcgtcgcgaaccggtgtgaccccgaccaactggtggtcatcgagaaggaactcgagaagaccggcatgccgacgctgtgcctgcccgaggagccggtcctgttcgcgccgacgatggccgaactgcgcgatgaactcggtgcccagatgtacagcggcgacgaggaactgctcgaccgcgaggcactcaaggtgatggtgggcgggatgaccgtcgagcacatcctcgagcgcctcaccgaggggaccgtcgtcatcaccccggcagatcggtccgacgtcctgctggctctcgtcaatgccaatacggcacaagggtttccgcgcctctccggaatcatcctcaacggtgggctgcggccccatccgatgatcgaggcactggtccgcggactcaaacccacgctgccgatcatcgcctgcgagcagggcacgtatgagacagcgcgtacggcggcgcacacgcgaggacgactcgccaaggggtcggcacgcaagatcgaggccgtgctgaacctggtggaagagcatgtggaccccgaaaaggtgctgcagaaactgaatgtcgggacgccgacggtcgtcacaccgcagatgttcgagtacggactcatcgctcgcgccaggtcggcacgcaagcacatcgttcttcccgagggcgacgaggatcgcgtcctgcgggccgcggggcggctggtccgccgcaacgtcgccgaactcaccctgctcggcgacaacgacgccgtgcgcgcccgcgcaagcgaactcgacgtcgatctcgacggggtgcacatcatcgatcccgcgtcgtcggagtacctcgacgaattcgcttcgctctacacggagttgcgcaaacacaaggggatggagttcgaccgtgcgcaggaattgatgcgtgacgtctcctacttcggcacgatgatggtgcacaccgggcgcgccgacgggatggtctcgggcgccgcccacaccaccgcgcacaccatccgccccgccttcgagatcatcaagacgcgcccgggggtgtccaccgtgtccagcgtgttcttcatgtgtctggccgatcgtgttctcgcctatggggattgcgcgatcgttcccgatccgaccgccgaacaactcgccgacatcgcgatcagctccgcgcagaccgccggacagttcgacatcgatccgcgggtggcgatgctctcgtactccaccggccagtccggctccggcgcagacgtcgacaaggtccgtgtcgcaacggatctggtccgtcagcgggcacccgaagtgcttgtggagggtccgatccagtacgacgcggcggtggacccgagtgtggccgccaccaagatgccggattcggaggtggccgggcgggcaaccgtgctcatcttccccgacctcaacaccggcaacaacacctacaaggcggtgcagcgcagcgcgggtgccgtcgcgatcggcccggtgttgcagggactcaacaaacccatcaacgacctgtcgcggggcgccctggtctccgacatcgtcaacacggtcgccatcaccgccatccaggcacagcagaacaccggtgacgcacgatga

SEQ ID NO: 1637 - DNA, 2100 bp, Jonesia denitrificans DSM 20603
gtgagcagcaaagcccgcagcgtctacatctcctcacccgaaggagaaaccggtaaatcaacaatcgccctcggcgtcgttgatctcctcagccggcaagtacaacgcgtcggggtgttccgccccatcacccgcaacggagcaaactcacgcgacgaagtcggcgaacgcgactacgttctcgagctcctcctcgcccacgatggcgtcgacctctcctacgatcaatgcaccggcgcaacctacgccgaagtccaccacgaccccgaagcagctctcgccaacatcgtggcccgataccgcgagatggaacgcaactgcgacgctgtggtcattgttggatccgactacactgacgttgccggccccactgagcttgccttcaacgcccggatcgcagcgaacctgggcgcccccgtcctcctcgtcctgtccggaaacggtcggtccccagaaggaatccgccaactcttcgacgtctccgtctcagagttgagcgccaactacgcctccgtcatggggacaatcgtcaaccgctgcctcaccggctccatccccgccgtgcaacaagtcttcgccgatgtgaccgtccccacctggacagtcccggaagagcctttcctcaccgcacccaccgtccaacaactcatgcgcgcggtaggtggtgaacttgttaacggtgacgacgaactcctgggacgtgaagtcctcgacgtcctcgttggagcgatgaccttcgaccacctcctcgaaaagctcgtcgacggcgccgtggtcatcacccccggtgaccgagtcgatgtgcttctcggactgcttgtagcgcaaaccgcaaagtcgtttccatcacttgcaggtatcatcctcaacggcgggttctaccccccggaaaacgtctcacgcctcctcgacgacatcaacccctccgtacccatcattcacacctcactgggaaccttccgcaccgcttcagccgccgcatctgtccgcggacgcctgtccaaagaagcgcaacgcaaagtcgacacagcccttgccctgttcgaacaaaacattgactcccaggcgatcctggctgcactcgaagtgcaacgaccagaagccgtcacccccctcatgttcgaatacgatcttcttgcccgggcgcgggaagacaaaaaacacattgttctccccgaaggaactgacgaccgtatcctgcgcgccgcatccacactgttgcaacgtcaagtcgctgacctgaccatccttggtgacgaaccactgatccgagcacgcgccaccgaactgggcctcgatatctcagatgcccaaatcatcaaccccaaatccggtgagatgcatgaacggttcgcgcaagaatacgcccaactccgcgcccacaaaggcgtcaccgttgaccgcgcccgggaaatcgtctcctctgtgtcctacttcggaaccatgatggtgcaactcgggctcgcagacggaatggtgtccggtgccgcacacaccacagcacacaccatccgccccgccttcgaaatcatcaaaacagttcctgacgtatccgtggtctcctccgtgttcttcatgtgcctcgaagaccgtgtcctcgtctacggtgactgcgcagtcaaccctgaccccacagcggaacaactcgccgacatcgcgatctcctccgcgcaaacagcagcacagtttggggtctccccccgcattgccatgctctcctactcaacaggagactccggcactggtgtggacgtcgacaaggtccgcgcagccaccgaaattgttcgcgaacgccgccctgacctcgaagttgaaggccccattcagtacgacgccgcagttgacgcctcagttgctgcctccaaactgcctgactctgcggtcgctgggcgtgcaaccgtgttcatcttccccgacctcaacactgggaacaacacgtacaaagcagtccaacgctcagccggtgctgtggctgtcggcccagttcttcaggggctacgtaaacctgtcaacgacttgtcgcgcggcgcactagtccaagacatcgtcaacaccgtcgcgatcaccgcaatccaagcacaaaaccagcccgcctcgtga

SEQ ID NO: 1638 - DNA, 2196 bp, Sanguibacter keddieii DSM 10542
gtgagctccaccgctcgcagcatcttcatcacgtcccccgagggtgagaccggcaagtccaccgtcgccctcggggtcctcgacctcctcacgcgccgcgtgcagcgtgtcggtgtgttccgtccggtcacccggacggggcacaccgcccgcggcacggccgcctcggccgaagggtcagaacgcgactacgtcgtcgagctgctcctggcgcacgacggcgtggacctcacgtacgaggactgcgtcggcgtcacctacgacgacctgcacgccgaccccgaggccgccctctcgcagatcctcaccaagtaccacgaggtcgagaagaagtgcgacctcgtggtcatcgtcggcaccgactacaccgacgtgaccggccccaccgagctggccttcaacgcgcggatcgccgcgaacctcggcgccccggtgctcctggtgctctccggccgcgaccgctcccccgcgggcatccggcagatgagcgaggtgtcggtctccgagctgcagtccaaccacgcccaggtgatcggcgtcgtggcgaaccgctgcttccccgacgacctcgaggccatccgtgccgagttcgccggcgacgacctccccgtgtggaccatgccggacgacccgtacctcatggcgccgaccgtcaagcagctgatgggcgccgtcggcggccgcctgctgctcggcgaggaagagctcctcggccgcgaggtcctcgacgtcctcgtcggcgcgatgaacttcgagcacctgctcgaccggctggccgacggtgccgtggtcatcaccccgggcgaccggaccgacgtcctgctcgggctgctcaccgcgcagaccgccaagaacttcccgtcgctcgccggcatcatcctcaacggcgggttcctcccgcacgagtcggtgagccggctcatcgccgacctcgcaccgagcgtcccgatcatccagacggacctcgggaccttccggtcggcgagcgccgcggcctctgcccgcgggcgggtcaccaaggactctcagcgcaagatcgacaccgccctcgcgctgttcgagcagaacgtggactccacctcgctgctcgcgagcctcgacgtcgagcgcaccggggtcgtcaccccgctgatgttcgagtacgagctcctcaaccgggcccgcgccgaccgcaagcacatcgtcctgcccgagggcaccgacgaccggatcctgcgcgcggcgtccacgctgctgcagcgccaggtggcgcacctgacgctcctcggcgacgaggagtcgatccgcgcccgcgccgtcgagctcggcctggacatctccgaggcgaaggtcctcgacccgcactccggcgagatgcacgaggagttcgcgcaggcctacacgacgatgcgcgcccacaagggcatgaccgtcgaccgtgcgcgggagatcgtcagctcggtgtcgtacttcggcaccatgatggtccagctcgggtacgccgacggcatggtctcgggagcggcgcacaccaccgcccacacgatccgcccggccttcgagatcatcaagacggtcccgaacacgtcggtcgtctcgtcggtgttcctcatgtgcctcgaggaccgcgtgctcgtctacggcgactgcgccgtcaacccggacccgaccgcagagcagctcgcggacatcgcgatctcctccgcggcgacggccgcccagttcggcgtggagccgcgcatcgcgatgctctcgtactcgaccggcgagtccggcaccggtgccgacgtcgacaaggtgcgggctgccaccgccctggtccgcgagcgccgccccgacctgtccgtcgagggccccatccagtacgacgcggccgtcgacgcctcggtcgccgcctcgaagatgcccgactcggccgtcgcaggccgcgcgacggtgttcgtgttccccgacctcaacaccgggaacaacacgtacaaggccgtccagcggtccgccggtgcggtcgccgtcggacccgtcctgcagggtctgcgcatgccggtcaacgacctgtcgcgcggcgccctcgtccaggacatcgtcaacaccgtcgccatcaccgccatccaggcgcaggcgctctcggccgagaaggcccgcgtcgccggagcgcacgcagagcccgcggcagtccccgccgcaggtacccacggagcaggagcacacaccgcatga

SEQ ID NO: 1639 - DNA, 2088 bp, Cellulomonas flavigena DSM 20109
gtggccaggacgatctacgtcatgtcggccgagggggacacgggcaagtccgtcgtcgcgctcggtctcgtcgacctgctgacacgcaccgtgcagcgcgtgggcgtgttccgccccgtcgcacggtcgaccgaggagcgggactacgtcctcgagctgctgctcgagcacgacggcgtcgacatcgcgtacgaggacgcggtcggcgcgacgtacgacgaggtgatcgacgacgccgaggccgcgctgtcacggatcgtgtcgcggttccacgacgtggaacggcgctgcgacgcggtcgtcgtggtcggcaccgactacacggacgtcgccggccccaccgagctcgcgtacaacgcgcgcatcgcggccaacctgggcgcgcccgtcgtgctcgtcgtcaacggtgcgcgccgtaccccggaggacgtcaaccacgccgccgaggtcgccgtcaacgagatcaccgcgaaccacgggcaggtcgtgtcggtcgtcgcgaaccgctgcgcgcccgacgcgctggacgacgtgcgcgccgccctcggcagcgagctgccggtgtgggcgctgccggactccccgctgctgtacgccccgacgctgcgccagctcatgcacgcggtcggcggcacgctgaccggcggcgacgaggcactgctcggccgcgaggtgctcgacgtgctggtcggcgcgatgtcgatcgagcacctgctcgaccgcctgcaggacggcgcggtcgtcatcaccccgggcgaccggtcggacgtcctgctgggcctgctgatggcgcaccaggccgagggcttcccctcgctcgcgggcctcatcctcaacggcgggctcgcacccgccccgacgatcgagcgtctcgtcggcggtctgggctcccggctgccgctcatcacgacgtccatgggcacgttccgctccgcgagcgccgcggcgtcgacgcgtgggcgcctcacgtacgacgcggcgcgcaagatcgacaccgcgctcgcgctgttcgagcagcacgtggacggcgccgagctgctcgccacgctcgacgtggaacggcccgaggtcgtcacgccgctgatgttcgagtacgcgctgctcgaccgcgcccgcgccgaccgcaagcacgtggtgctgcccgagggcaacgacgaccggatcctgcgagccgcctcgacgctgctgcagcggcaggtcgcggacctgacgatcctcggggacgaggcggcgatccgtgcccgcgccaccgagctcggcctcgacctcgacgacgcccaggtcatcgaccccaagaacggcgagacgctcgagcggttcgccgaggtgtacaccgagctgcgcaagcacaagggcatgacggtcgagcgggcgcgcgagatcgtgtcgtccgtgtcgtacttcggcacgctcatggtgcagctcggcctggcggacggcatggtgtccggcgcggcccacaccaccgcgcacacgatcaagccggcgttcgagatcatcaagaccacgccgggcgtggggtcggtgtcgagctgcttcctcatgtgcctcgaggaccgcgtcctggtctacgccgactgcgccgtgatccccgacccgacggccgagcagctcgcggacatcgcgatctcgtccgcggagacggcggtgcagttcgggatcgagccgcgcatcgcgatgctgtcctactcgacgggcgagtccggctcgggagccgacgtcgagaaggtccgcgaggccacccgcctggtccgcgaacgccggcccgacctgtcggtcgagggtccgatccagtacgacgccgccgtcgacgcgtccgtcgcccagacgaagatgcccgactccgccgtcgcagggcgcgccacggtgttcgtcttcccggacctcaacacgggcaacaacacctacaaggccgtgcagcgctcggccggcgccgtcgcgatcggcccggtgctgcaggggctgcgcaagccggtcaacgacctgtcgcgcggcgccctcgtgcaggacatcgtcaacaccgtcgcgatcaccgcgatccaggcgcaggcgctcgacgccggcgccgtcccgaccccggaggcatga

SEQ ID NO: 1640 - DNA, 2106 bp, Beutenbergia cavernae DSM 12333
atgtcgcgcaacttctacgtgacctcgcccgagggtcacacgggcaagtccgccatcgcgctgggcctcctcgacctgttcgtgcggcgcgtcagcagggtgggggtgttccgcccggtgatccgcggcggcggccagcgcgacaccgtgctcgagctgctgctcgcgcacgacggcgtcgacctcacgtacgacgagtgcgtgggcgtgacgtacgacgaggtccacgcggaccccgacgccgcgctcgacacgatcgtcacgcggttccggcaggtcgacgcccggtgcgaggtggtcgtcgtggtggggtcggactacaccgacgtcgtcggccccaccgagctcagcttcaacgcccgcgtcgccgcgaacctgggcgccgccgtcgtcctcgtggtgcgagccctggaccgcactcccgacgacgtccggcaggtcgtcgacgtgtcggtggcggagatccgcagccgccacgcggcggtgggcgccgtcgtcgtcaaccggtccgccgaggccgacatggacgacgtccgtgccgctctgatgagcgtggggccggtgtgggtgctgccggacaccccgctgctcgcggcgccgagcgtgcgcgacctcatgacggcgctcgacgggtcgttgcggagcggcgacgagcagctcctcgaccgcgaggccgagcacatcgtcgtcggcgccatgggcatcgaccacctgctcgaccggatcgtcgaggggtcggtcgtgatcaccccggccgaccggtcggacgcgatcctcgcgctgatgagcgcccacgcggcggacggcttcccgacgctcgccgcgatcgtcctcaacggcggcttcgagccgtccgcgcaggtcggccggctcgtcgagggcctcgggcagcggctgccggtggtgaccacgcagctcggcacgttcgcggccgcgagcgcggccgccggggtgcgcgggctcctcagcacggggtcgcagcggaagatcgacgtcgcgcggtcgctgttcgagacgcacgtcgacggcgacgcgatcgtgtcggcgctcgacctgcccgcgaccgacgtcgtcacgccgctcatgttcgagcacacgctcatcgagcgggcccggtcgcaccgacggcacatcgtcctgcccgagggcggtgacgaccgcatcctgcgtgccgccagcacgctcctcgcgcgcggcgtcgccgacctgacgatcctcggcgtcgagtccgccgtacggtcccgggccgccgagctcgggctcgacatcgaggcggcggacgtgctggaccccgcgacgtccgacctgctggaggagttcgccgccgagtacgcccgggtgcgcgcccacaaggggatgacgcccgaccgggcaagggagatcgtgagtgacgtctcctacttcggcacgctcatggtgcacacgaagcgggccgacggcatggtgtccggcgcgcagcacaccacggcgcacaccatcaagccgtcgttcgagatcatcaagacggcgccgggcgtggacatcgtgtcgagctgcttcttcatgtgcctcgcggaccgggtgctcgtgtacgccgactgcgccgtgaacccggacccggacgcgacccagctcgcggacatcgccatctcctcggcggacacggcgcagcagttcggcgtgagcccgctcatcgcgatgctgtcgtactcgaccggcgagtccgggaccggcgcggaggtggacaaggtgcgctccgcgaccgggctcgtgcgcgagcgggcgccccagctggtggtcgaggggccgatccagtacgacgcggctgtcgacgccggggtggcggcctcgaagatgcccgggtccgctgtcgccggtcaggcgaccgtgctgatcttccccgacctcaacacgggcaacaacacgtacaaggcggtgcagcgcagtgccggggccgtcgccgtcgggccggtcctgcagggcctggcgaagcccgtcaacgacctctcccgaggagcgaccgtcaaggacatcgtcaacaccgtggccatcacggcgatccaggcccaggcagcagagggcgctgccgaccggggcagcgacgagagctcgggaggcagcgcgtga

SEQ ID NO: 1641 - DNA, 2100 bp, Xylanimonas cellulosilytica DSM 15894
atgacggccaagcgcaccatcgtcatcgcctcccccgagggagagtccggaaagtccacgatcgcactcggcgtcatcgacctgctcgtgcgccagggacagcgtgtcggggtgttccggccggtctcgcgggtctcgtcggccgaggcggcccatgatgacggcaccgggcgcgaccacgtgctggagatgctgctcgagcacgacggcgtcgacctcacctacgaggagtccgtcggcatcacctacgacgacgtccacgccgacgtcgacagcgcgatgagccgcatcgtggcgcgctaccacgacgtcgcggcccggtgcgactccgtcgtcgtcctcggcaccgactacaccgacgtctccggccccaccgagctggcgttcaacgcgaagatcgccgccaacctgggcgcccccgtgctgctcgtggtctccggccgcggccgctccgacgaggacaccaaggcgctgacgcagatcggcctcggcgagctgcgcgccaaccacgccacccccatcggcgtcatgatcaaccgctacgacggcacgacgccgcccgacgtcgccgcgctcaccgccgacccggagctgcccgtgtgggtggtgcccgaggagccgttcctgcacgccccgaccgtgcgccagctcatggagtccgtgggcggggagctgtggctcggcgactccgagctgctgtcccgcgaggcgctcgacgtgatcgtcggcgcgatgtcggtggggcatctgctcgaccacctgtccgacggctgcgtcgtcatcaccccgggcgaccgttccgacgtcatcctctccctgctcgcggcgcagagcgccgtgagcttcccgtccatggccggcatcatcctgacgggcgggatgacgcccgagggaaccatcggtgagctggtgaccgcgctcgcaccgcacgtgccgctcatccgcaccgcgcaggacacgttccccgcggcccgcaccgcgggcgccacggtgggccgggtgtccgccgacgcgacgcgcaaggtcgacgtcgcccgcggcctgttcgagtccgccgtcgacagcgaggacctgctcgcccgcctggccgtgcccagcccgtccgtggtcacgccgctgatgttcgagtacgagctcatcgagcgggcccgcgccgaccgccgccgcgtcgtgctgcccgagggcgacgacgaccgcgtcctgcgtgccgcgtcgaccgtgctcgcccgcggcatcgcggacctgaccatcctcggcgacgagacctcggtgcgggcccgcgccaccgagctgggcctcgacatctcggccgccaccgtgctctcccccaccgacccggtgcacgtcgagaagtacgccgccgagtacacgcgcctgcgcgcccacaagggcatgacggtcgaacgggcccgggagatcgtcaccgacgtgtcctacttcggcacgatgatggtccacgtgggcgacgcccacggcatggtctcgggtgccgcccacacgacggcgcacaccatccgcccgtccttcgagatcatcaagaccgcccccggcatctcctcggtgtcgggcgtgttcctcatgtgcctcgaggaccgggtgctggtgtacggcgactgcgccgtcatccccgacccgacgacggagcagctcgccgacgtcgccatcgcgtccgcggccaccgcggcgcagttcggcgtcgagccgcgcatcgccatgctgtcgtactcgaccggcgagtccggctcgggcgccgacgtcgacaaggtgcgcgcggccaccgcgatcgtcaaggaacgccgccccgacctctccgtcgaagggcccatccagtacgatgccgccgtcgacgccgccgtggccgcctcgaagctgccgggatccgatgtcgccggccgggcgaccgtgttcgtgttcccggacctcaacaccggcaacaacacctacaaggccgtgcagcgctcggcgggtgccgtggccgtcggcccggtgctccagggtctcaacaagcccgtcaacgacctgtcccgcggcgcgctcgtccaggacatcatcaacaccgtcgccatcacggcgatccaggcacagggggccacagagtga

SEQ ID NO: 1642 - DNA, 2091 bp, Nocardioides sp. JS614
gtgtgcacgagcgtctacgtcgcgtccgtcgagggctacaccggcaagtcagcggtcgcgctggggatcctggacgtgctctcccgcagggtcgagcgggtcggggtgttccgcccgatcgtgcgcaacgaccaggccaccgcgcgcggtgagcgcgactacgtcctggacctgctgaccgcccacgaggcggtcacgctcagctacgacgactgcaccggcgtcacctacgacgacgtccacgccgacccggtcgccgccctggacacgatcgtcgagcgctaccaccgggtcgcggagcagtgcgacgccgtggtggtgatcggctcggactacaccgacgtcgccacccccaccgagctgtcctacaacgcgcggatcgctgccaacctcagctcgccggtcctcctcgtcctcaacggcgcggaccggacgcccgccgagctggtgacgctggccgacatcgccagcaccgcgatctcggccagtcacgcggcactgttcgcggtggtcgccaaccgggtcacccaccccgagcccgccgaggtcgtcgccgccctcggccgcgacgaggtgccggcgtacgcgatcccctacgacccgctgctctcggccccctcggtcgccgacctgatgcccgcctgcaacgggacggtcgtctccggggacccggccctgctcgaccgcgaggtgctcggcctcctggtggctggcatgacgatgccgaacgtgctggaccggctcttcgacggcgccgtcgtcgtgactgcgggcgaccggcccgaggtggtgctgggcgtcttgatggcgcacgtgtcgtcgaacttcccgcaggtcgccggcatcgtgctcaacggcgggatcgagctgcccgcccaggtcgcccgcctgttggcgggcatcggcgccacgctgccgatcatcgcgaccgacctggccacccaggagacctcggcggcgctcaccggcgtccgtggccgcctgaccgtgagctcgccccgcaagatcgcggcggcgctggccctgttcgcccagcacgtcgagggcgacgcgctgctcgaccggctcgacgtgtcgccgacgaccgcggtgaccccgctgatgttcgagcaccagctcctggactcggcgaccagccggcggatgcggatcgtgctcccggagggcgaggaggaacggatcctgcgcgccgccgacctgctgctgcgccgcggcgtggccgacctgacgctgctcggcgacccgatccggatcaatgcgcacgccgcccgggtcggagccgacgtctcggccgccaccctgctcgacccccggtcctccgagctcgctgagcggttcgccgaggagtacttcgaccggcgcaagcaccgcggcgtggaccgcgacgacgcgctcgtccgggtgctcgacgagtcctacttcggcaccctgatggtcgagctcgggctcgccgacgggatggtctccggcgccgtccacacgacggcccacacgatccggccggcgctcgaggtggtccgcacggcgcccggggtgtcggtcgtgtcgtcggtgttcttcatgtgcctggagaaccaggtcctcgtgtacggcgactgcgcggtcaacccggacccgaccgcggagcagctcgccgacatcgcgatctcctcggccgagaccgccgcggcgttcggtgtcgagccgcgggtcgcgatgctgtcctacgcgaccgggtcctccggagccggcagcgacgtcgagaaggtctcggcggccacggcgctggtccgcgaccgggccccggagctgctggtcgaggggccgatccagtacgacgcggccatcgaccccgcggtcgcccggaccaagctcccgggatcgccggttgccggccaggcgacggtgttcatcttcccggacctcaacaccggcaacaacacctacaaggcggtgcagcgctccgccggcgcggtcgcgatcggcccggtgctgcaggggctgcgcaagccggtcaacgacctgtcccgcggcgcgacggttcgcgacatcgtcaacaccgtcgcgatcaccgctgtccaggcccagcagctcgccgaggtcgcccgatga

SEQ ID NO: 1643 - DNA, 2130 bp, Kribbella flavida DSM 17836
atggggagcagcgtgtacgtcgcgtccgtggagggttccaccgggaagtcgacggtggccctcggggtgttgcagcagttgtcgcgacgggtggggcgggtggcagttttccgccccatcgtccggccggacaccgccaggcacggcgggcgcgactacgtgctggacctgctgatctcgcacgacgcggtggacctggcgtacgaggactgtgtcggcgtcacctacgacgaggtgcacgacgacccggaggcggcgctggacgtgatcgtccggcgctaccacgacgtggccgagcgggccgacgcggtgctggtggtcggcagcgactacaccgacgtcggtacgccgaccgagttctcctacaacgcgaagatcgcggcgaacctcgggacgccggtgctgctcgtgctcaacgggttccgccggagtctggaggacctgcgggcgatcgcggacctggccgtcgccgagctgacggccaaccacggggcactggccgcggtcgtcgccaaccgggtcaacccgcacgacctcggccggaccgtcggcgcgctggccggcgtcggcgtaccggcgtacgcgctgccggaggagccggtcctgagtcagccgacgccggcggatctgctcgagccgatcgccggccggatgctgagcggtgatcccgagctgctgtcgcgggaggtcaccgggctggtggtggccgggatgacgatgccgaacgtgctcgaccggctgttcgacggagccgcggtgatcaccgccgcggaccggcccgaggtggtgctcggcgtgctgatggcgcatgcctcgcgcaccttcccgcagatctcggcgatcgtgctcaacggcgggttcaccctgcccgcccaggtccagcggctgatcgagggcctcggcgtgacgctgccgatcctggagacggacctcgacacccaagcggcgtcggcggcgctcaccgccgtccggggccggctcacgaaggactcgccgcgcaagctcgacaccgcgctcgcgttgttcgagcagcacgtcgacagccaggcgttgctggaccagctcgcggtggcccgcagcagcgcggtgacgccgttgatgttcgagcaccagctgatcgacgcggcagttgccgaccgcaagcacattgtgctgccggagggcgaggaggaacgcatcctccgggcggccgacgtcctgctgcggcgtggggtggccgagctgaccctgctcggggacccggtcgcgatcagcgcgaaggcggccggcctcggcctcgacctgtccgcggcgaaggtcgtcgatcccgagaacgacccgctggcggagcagttcgcgctggagctgcaccggctgcggcagcatcgcggcgtcgacctggaccgggcccgcgagctggtcaaggacgtgtcgtacttcggcacgatgatggtccagctcgggctcgccgacggcatggtgtcgggctcggtgcacacgaccgcgcacacgatccggccggccctggagatcgtcaagacggtcccgggggtgtcggtggtgtcctcggtgttcttcatgtgcctgcagcaccaggtcctggtgtacggcgactgcgcggtcaatcccgatccgaccgccgagcagctggccgacatcggcatctcctcggccgcgacagctgttgccttcggcatcgagccgcgggtcgcgatgctgtcgtactcgaccgggacgtcgggcaccggcaccgacgtggagaaggtgtcggcggcgaccgcgatcatccgggaccgggcgcccgacctgctggtcgagggcccgatccagtacgacgcggcgatcgacgccgcggtcgcgcggacgaagctgccgggatcgccggtcgcgggccgggcgacggtgttcgtctttcccgacctcaacaccggcaacaacacgtacaaggcggtgcagcggtccgcgaacgcggtggcggtgggaccggtcctgcaggggctgcgcaaaccggtgaacgacctgtcccggggtgcgaccgtgcgggacatcgtcaacaccgtcgcgatcaccgccctgcaggcccagcaggccaagccggccgtcgaatcgagcggaccggccacggtgccggtggaaggcggcagccggtga

SEQ ID NO: 1644 - DNA, 2169 bp, marine actinobacterium PHSC20C1
gtggcgcagaacatctacatcacttccatcgagggccacgctggcaagtccactgtcgccctcggtctgctcgatacgctcagtcgcgaagcaaaacgccttggagtgtttaggccggtcgcgcgcaccagtaatgaacgcgattatgtgctggaaatgttgctcgcccatgacgccgtcaatctcaactacgacgatgctgtcggtgtcggttatgacgatgtgcacgctgaccctgaggcggcactgagtcgcatcgtcgagcggtttaaggctgtcgaagcgcagtgcgatgtcgtcgtgattgtcggctcggactacacggatgtcggcagccccaccgagctctcttataacgcgcgggtcgctgcgaaccttggcgccccggttctccttgttttgggcggacagtctgaggatggcgagagccgcagccctgacgccctcgctcaggtctatgcgatcgcgcatcaggagttggatgccgctcatgcccaactcgtcggtgtgattgtgaaccggtctgaccccgatcatcttgccgatgtaattgcaggagtgagtgctgcggtcggcggcgatacgccggtgtgggcaattcctgaggacccgttcctgattgcgccaagcttggcggcgctgcttgcggcagttgaaggtgagctactcaagggcgatagtgaccttctccttcgtgaagctctcggggtagttgttgccggaatgacaatggagaacgtgctgactcggctgatcgaaggatcggttgttgtggtcgccggtgaccgatcagatgtgctgttggcgacactgatggcccacgcatcggagacgttcccgtcactcgcgggcatcatcctcaatggtggttttgagttgttgcctcagatcgagcggctcatcgatggtctcgatctctcgctgccggtcatccgcacctcattgggtacgtatgacactgcgcgcattattacgaagactcgtggtcggttggcggccgattcgccccgcaaattcgatactgcgctcgcactctttgaacagaatgtggatgccgaggtgctgttacagcgtctcgaacttaacccaccaacggtggttacgcccctcatgtttgagtacggcttgcttgaccgtgctcgcaagaatccacagcacattgtcctgccggagggcggcgacgaccgtatcttgcgcgcgtcaagcacactgttgcgtcgaggcgttgcgaagttgacgattctgggcgatgagggcgaagtgcgaggtcgtgccgcagagttaggtctcgacatttcggcggcgcacgtcgtgagccctttcgacgaaaacttccgctcgcaattcgccaccgaatatgttcggctgcgggcgcataagggaatgactatggagactgccagagatactgtcactgatgtttcgtatttcggaaccatgatggtgcacttgggtctggctgacggcatggtctctggggccgcgcatacgacagctcacaccatccggcctagcttcgaaatcatcaaaaccaagcctgatgtttccattgtgtcgagtgtctttctgatgtgtctcgaagatcgggtgctcgtctacggtgactgtgcggtgaacccagaccctgatgcggcacagctcgccgatattgcaatctcgtcggcagcgacggccgaacagttcggcattgagcagcgcatcgccatgctgtcgtattcgacaggaacttcaggcagcggagcggatgtcgacaaggttcgattagcaaccactcttgtcagtgaacgccgccccgatcttgccgtcgacggccctattcaatatgacgccgcggtggatgctgcggtcggcaaatccaagatgcccggatctgaggtggccggccgcgccaccgtgttcgtgtttcccgatctcaatacgggaaacaacacctacaaggcagttcagcgcagtgcaggtgctgtagccattggtcctgtgttgcaggggctacgcaagccgatcaacgatctttcgcggggtgccctggttcaagacattgtgaatactgtcgccatcactgccattcaggcacagtcggtagcggccgaagctgccgcaactgcggcgaccattgttacggcgtcggcgccgcaccatgctgctccttctcacggaaaacactcatga

SEQ ID NO: 1645 - DNA, 2118 bp, Clavibacter michiganensis subsp. sepedonicus
atggctcggagcatctacatcacgtccgccgaagggcactcgggcaagtcgacggtcgcgctgggggtgctcgacaccctgacccaccagatccagcgcgtgggcgtgttccgtcccatcgcgcgctccatcgtcgagcgcgactacgtgctcgaggcgctgctgtcgcacgacggcgtggacctcgactacgacgagtgcgtgggcgtcacctacgacgacgtgcacgcggatcccgaggccgcgctctcccgcatcgtcgagcgctacaaggccgtcgaggccaagtgcgacgccgtcgtcatcgtcggcagcgactacaccgacgtcggcagccccacggagctgtcgttcaacgcgcgcatcgcggcgaacctcggcgcccccgtgctcctcgtgctcacgggccgccgcacggacgagaccggcggccgcagccccgacgagatgcgccagatcgccgacctcgcgatccccgagctggtgaccgcgcacgcgggcctcctgggcgtcgtcgtgaaccgcgccgaccccgagcagctcgacgccatcacggccgcgatccccgccgccgtccccgcatcgctccaggcgcaggccccgcacgtgccggtctgggcgatccccgaggacgcgttcctcgtcgcccccaccgtcgccgagctcctcgacgcggtcgacggcacgctcgtcaagggcgacgcggcgctcctcagccgggaagcgctcggcgtggtcgtctccgccatgtcgatggagaacgtgctcgcgcgcctcaccgagggcgccatcgtcgtgatccccggcgaccgcagcgaggtcctcctcggcgtgctcacggcgcacgcctccgagaccttccccacggtcgcgggcatcgtgctgaacggcggcttcgcgctgtcgcccaccatcgagcgcctcgtctccgggctcgacgagacgctgccgatcatctccaccgagctcggcacgtacgagaccgcgaagcgcatcacgcagacccgcggccggctctcgcccgagtccagccgcaagatggacacggcgctcgccgccttcgagcagcacgtcgacacgtcgcggctcctcgagctgctcgacgtcagccgctccgacgtggtcaccccgctcatgttcgagtacgggctcatcgagcgggccaggaaggccggcaagcgcatcgtgctgcccgagggcaccgacgaccgcgtgttgcgggcggccggcacgatcctcagccgcggcatcgccgacgtcacgatcctcggcgaggagatcgaggtgcgctcgcgggccatcggcctcggcatcgacatcgggcgcgccaccgtgctcagccccttcgacgccgtgctgcgcgagcgcttcgccgaggagtacgtgcgcttgcgcgcccacaagggcatggtgctcgacatcgcgcgcgagaccgtcaccgacgtctcgtacttcggcacgatgatggtgcagctcgggctcgccgacggcatggtgtcgggcgccgcgcacacgacggcgcacaccatccggccgggcttcgagatcatcaagaccacggacggcgtctccgtcgtctcgtcggtcttcctcatggcgctcgccgaccgggtgctcgtctacggcgactgcgccgtgaacccggatcccaccgccgaccagctcgccgacatcgccatctcgtcggcggggaccgcggcgcagttcggcatcgagccgcgcatcgcgatgctgtcgtactcgacgggggagtcgggcgcgggtgccgacgtggagaaggtgcgccaggccacggcgcgcgtgcgggagctgcggcccgacctcgcggtcgagggacccatccagtacgacgcggcggcggacgcggcggtcgcggccacgaagatgcccggctccgaggtcgccggccgcgcgacggtgttcatcttcccggacctcaacacgggcaacaacacgtacaaggccgtgcagcgctcggccggcgcggtcgccatcgggcccgtgctgcaggggctccgcaagcccatcaacgacctctcgcgcggcgcgctcgtgcaggacatcgtcaacaccgtcgccatcaccgccatccaggccgaggggatcgaggcgggctga

SEQ ID NO: 1646 - DNA, 2130 bp, Leifsonia xyli subsp. xyli str. CTCB07
gtggcaaggtcgctctacatcacctcggccgaggggcacaccggcaaatcgacggtcgctctcggcgtgctggaggcgttgcggcactcggtcgaacgggtcgcggtgttccggccgatcgcccgctccacggtcgagcgcgactacgtgctcgatctgctgctcactcgcgtgaccgcgcagatcggctacgaggaggcggtcggcgtcagctacgaggacgtccacgcggacgcggacgcggcgctcggcgaaatcgtccggcggttccgggctgtggaggccaaagccgacgccgtcgtcatcctcggctcagactacaccgatgtcggcagcccgaccgagctcggctataacgcgcgtatcgccgcgaatctgggcgccccggcgctgcttgtgctcggcggacgggtcggccagggcttcggggagcgtctcgggcaggctgacccgcgctctccggaggagctgcggcagctggcggagctcgccgtcgccgagcttcgcgccgagcacgccggactgctcgcggtggtcgcgaaccgcgcggacagcgatcggctggagacgatcgtcgaagcggtcggcgaagcggtggccgcgggtgccccggctcagggcgcccggccgcaggtgtgggccatcccggaagaccccttcctcgtcgcgccgagcatccgctcgatcatggaggtcaccgccggcgagctgctcgccggcgaccgcgagctgctggcgcgtgaggcgctgggcgtggtcgtggcgggcatgtcgatgaacaatgtgctgcctcgtctggtggagggggcggtcgtggtggtccctggcgaccgcaccgaggtcctgctcgccgtgctgatggcgaacgcgtccggaacgttctcctctgtcgccgggatcgtgctcaacggcggcttcgagctgcccgagccgatcgagcgcctgctggcgggtctgcgctcgccgctgccgatcgtttacacgtggctcgacacctacgagacggtggtccgcatcacgcacgcgcgcggccggctggccgcggactcgcagcggaagtacgacacagcgctcgccctgttcgagcggcatgtggatgccggggcgctgctcgcgcgcctcgatgtcacccgtcacgaggtcgtgacgccgctgatgttcgagtacgacctgatcgagcgcgcccgcgccgccgacaagcacatcgtgctgccggagggggaggacgaccgcatcctgcgcgccgctgcgaccctgcttgcccgcggtgtggcccggctcaccatcctcggcgagccgttcgaggtgcgttcgcgcgcgatcgagatcggtctggacatctccggcgcggaggtgctcagcccgttcgacgatgtgctgcggctgcgcttcgcgcacgagtacgccgaactgcgcgcacacaagggcatcacggtcgatcaggcgtcggacacggtgacggacccgtcctacttcggcacgatgatggtccacgctgggctcgccgacggcatggtgtcgggggccgcgaacacgacggcgcacaccatccgcccggcgttcgagatcatcaagaccagcccgagcgtctcggtcgtgtcgagcgtgttcctgatggcgctcgccgaccgggtgctcgtctacggcgactgcgcggtcatcccggacccgaccgccgagcagctcgccgacatcgcggtctcctcggcgcgaaccgccggccagttcggcatcgagccgagggtggcgatgctctcctactcgaccggcgactcgggcacgggggcggatgtggacaaggtgcgcaccgcgacggcgctcgtccgcgaccgggcgccgcagctcccggtggccgggccgatccagtacgacgccgccgcggacgccgcggtcggcgccgccaagatgcccggctcggaggtggccggccgcgccacagtgttcgtcttcccggacctcaacaccgggaacaacacctacaaggcggtccagcgcagcgccggggccgtcgccatcggcccggtgctgcagggcctcagaaagccgatcaacgacctctcgcgcggggcgacggtggacgacatcgtcaacacggtcgcgatcacggccatccaggcggccctgtcgtga

SEQ ID NO: 1647 - DNA, 2130 bp, Nitrosomonas eutropha C91
gtggccaagagtttgtacctgacgtctgccgaggggcgcaccggtaagagtgccgtagcacttggactactcgatgctcttctcgcggatatcccttctgtgggtatctttcggccgcttattcgctccggcagccaacgagatcgtgtgcttgagctgttgcgcgagcgcgcgggcggcatgatcccctatgaggtatgcgttggcgtgacctatgaagacgccgcgcacgacccggatgctgccatggtgcaaatcgtggctcgattcaaagcgctcgaagcgcaatgtgatgcggtcattattgtgggatctgacttcagcgacgttgcagcgccgagcgagcttgccttcaacgcgcgggttgcagcgcacctcgactcaccggtgctgctcgtgctgggcgggcgctcgtcccagagcggccccgagatcctcggtcagtctgcggcgcggactgccgcagagctcgcgcagcttgctcaactgagtctgcagcagctccaggctgcacacgtctcactgcttgccaccctggtcaatcgggcggatcctgacgcgctcgatcacattcgcagcgcggtcgccgttgtgttgccgccaatgaccccggtctgggcgattccggaggaggtgttgcttgtggctccaacggttgcgtcagtgcttgaggcggtcgagggaactttggtacgcggtagcgaggaactgctgagtcgtgaagtacccggcctcgttattgctggtatggcgatggagcacgtgctgccgcgactcatcgaaggtgcagccattgtggttgccgccgaccgggccgagactctgcttgctgttgtaatggcgcacgaggctgtaacttttccaacccttgcggcggtggtgctcaatggcgacttcgcgctctcacccgatatcgagcgattgctcgatggcattgattcgcggttgcccatcattcgcacttcccttggcacgttcgacacggcgcaacgcattgtccgcgcccgcggtgttctgacgcccgactcgcgtcgcaaaatcgatacagtccttgctctgttccgggagcacgtcgatgtgtttgacctgcgctcgcggctgagggtgtacactggtggcgtcgtcaccccactcatgtttgcgtacgagttgttcgagcgagcagcgacatttcagtcgcatattgtgctgccggagggcagtgacgaccggatcctgcgtgctgcgagcacgctacttttgcgcggtgtggtgcgactcactattcttggccagcccgcttcggtaaggcagcgtgcagccgagttggggcttgacctcgatcgtgccgatgtcattgatccagcagagtcgccgttatgcgagcagttcgccgaagagtacacgcggttgcgcgcgcataagggcgtcaagattgaggaggcccgtcaccgggtcaccgatgtcagctactttggcacgatgatggtgcactttggcctcgccgacggtatggtctcgggtgtcgcgcacaccaccgctcacacaatcaagccaagcttcgagatcatccgcgcgcgccctggcgtctcagttgtgtcaagcgtcttcttcatgttgcttgaggatcgggtgctcgtttatggtgactgcgcggtgaatcccaacccgaacgccgagcagctcgctgacattgcgatctcatcggccgagacagccgcccagttcggggtcgagcctcgcattgcgatgctctcgtactcgacgggtgggtcgggcagcggcgccgaggtcgatttggtgcgccgggccactcagcttgtgcgcgagcgccagcccacgttgcttgtcgacggtccgattcaatatgatgcagcgagcgacccagtgatcggggctgcgaagctgcctggatcacctgttgctggtcgcgccaccgttttcatcttccccgacctgaatacgggcaataatacctataaggctgtgcaacgctcggccggtgccattgcggtcggccctgtgctgcagggcctgaaccgtcccgtgaatgatctctcgcgtggtgccacggtcgaggatatcgtaaatactgtcgcgatcaccgctgtgcaggcagggctcgcgcgtaacaagaagaattccgtatga

SEQ ID NO: 1648 - DNA, 2145 bp, Catenulispora acidiphila DSM 44928
gtgggccgagaggcgagcgcggcacagggcctgtacatcaccgcgaccgatgccgccagcgggaagaccgtcgtcgcgctcggggtggccgaggccatgtcgcggcgcgtgcgccggctcggggtgttccggccggtggtccccggcggcggggcggtcgacgaggtcgtggagctgatccggacgcgctaccggatcgacgagccgtacgaggactgcgtcggcaccacctacgacgcggtccacctggacccggcgcgcgcggtcgagacgatcgtcgaccgctaccgggctttggcagcacgctgcgaagccgtggtcgtcgtcggctcggactacaccgacgccgcgaacaccgccgagttcggcttcaacgcgacggtcgcggccaacctcggcttgccggtgctgctggtggtcggcgggatggagcgcacgccgcaggacgtggccgccgtggtgcgggtgtcgcggcaggagctgacgcggctgcacgcgaccgagctggccgtgatcgtcaatcgggtggagcccgggcaggaggacgcggtacggcgcgaggtcgccgcggcgttcggatcggcgatcgacgacgcgaccccgctcgtctgcaccatccccgaggtcccgggcctgaccgcgccgacgatccgcgacttggtccgcgccgccgacggacagctgatcagcggcgacgaggcgttgttggaccgcgaggcgtcgtccttggtcgtggcggcgatgtcgttgccgaacgtgttggatcggctgaccgagggcgtcgcgatcatcgcgcccggcgaccgcaccgcgggtctggtgccgggactgttggcggcgcatgaggcggcgaacttcccggctttgtcaggggtcttccttaccggcgggttcacgctgccggccagcgtttcgcggctgctggaaggagtttcctcgccgctgccgatcatcaccagccatgaggacacgttgcccaccgcgctgcatttggcggcggtgcgcggggagatcaccgtcggacatccgggcaaggtcgagaccgcgcttggcgctttcgctcggggcgtggacacctcggtgctgctgaaccggctgaacgtgacgcggtcggtggcggtcacgccgctgatgttccaggcgcagctgttggaacgggctcgttcgcagcgtcggcgtatcgtgttgccggagggcggcgacgaccggattctgcgcgccgccgacatcgtggcgcgacgcggcgccgccgatctgctggtgctcggcgaggaggagaaggttcgggcgcgtgccaacgccttgggcttggacctcgccggagtgcggatcgtcagcccgaccgatgaggtactggtcgaggaattcgcccacgaatacacgcggctgcgcgagcgcaagggcatgacgctggacaaggcgcgcgacatcgttcaggacgtctcctatttcgggacgatgatggtccacaccgggcgtgccgacggcatggtgtcgggggcggtgcacacgacggcgcacaccattcggccggcgttcgagatcattcgcacggtgcccggggtctcggtggtgtcgagcgtgttcttcatgctgctggctgacagggttctggtttacggcgactgcgcggtcatccccgatccggacgccgagcagcttgcggacgtcgcggtctcgtcggcacggaccgccgcggctttcggggtgcagccgcgggtggcgatgctgtcgtactccagcggtgaatcagggtccggagaagacgtcgagaaggttcgcgaggcggcgaagctggcgcacgcgcgggatccggatctgttgctggagggcccgatccagtacgacgcggccgccgatcccgaggtcggggcgctcaagctgccggggagtgcggtcgcggggcgtgcgacggtgttcatcgtcccggacctgaacaccggcaacaacctctacaaggcggtgcagcgcagtgccggcgcgattgcggtcgggccggtgttgcagggtttgcgcaagccggtgaacgacctttcgcgcggggctctggtgcaggacatcgtgaacacgatcgtgatcacggcggtgcaggcacagggcgagacgggagagacgggtaagacgggagaagtgagcggaccgtga

SEQ ID NO: 1649 - DNA, 2094 bp, Nakamurella multipartita DSM 44233
atgaccggcccggttagcctgagccccatgtcgcgcagcctctatatcgcctcgcccgaggccctgtccggaaagtcggcggtggccctgggcctggtcgatctgctcagccggcgggtcggccgggtgggggtgttccggccgatcgtcaacgccgatccgcagcgcgactcggtggtcgagttgctgatcgcgcagcccggcatccggcaggactacgacgaggcggtcggcgtcacctacgcccagtggcacgccgatcaggacgccgcgctgtcccggatcgtggaccggttcggcgagctgagcgccgagtacgacgcggtcgtggtggtgggcagcgactacaccgacgtgaccaccggcaacgagtgggccagcaacgcccggatcgcggccaacctgggctcgccggtggtgctggtggtgcacggccgcgaccgcaccccggccgtcatcgccgcgaccgtcgagctggcccgctccgaactcgtggcctggcacgcccatccggtagccgctatcgccaaccgggtcgacccggacgcggtcgaggacgtccgcgagcggctgtcccgggccggcctggtcgccggcgcgctgcccaacatcccgctgctgggcgcgccgacggtggccgacctgcgcgacgcctgcggggcgacgctgtggcgcggtgacgaggacctgctgacccgggagtcgctgggcttcctggtcgccgcgatgaccccgccgaacgtgctccgccggctacggccgtcgatgaccgtgatcgcgcccggcgaccgctcggacatgctgccggcgctgatcctggcccaccagtcggccaccttcccggacctggcctcggtcgtgctgaccggcgggtacgagccgccggcctcgatcgccaagctgatcgacggcatccgggccgacgtaccgatcctgctcaccgacggcggaaccttcgagaccgccaccggtctggggcaggtacggggccggttgaccgcggactcctcggtcaagctggagaaggcgctgcaggcgttcgccgagggggtggacgccgacgccatcgtcgacgcgctggacctggccgacccgaccgtggtcaccccgatgatgttccagtaccggctgatcgagcgggcccgggccgaccgccggcacgtggtgctgcccgagggcgaggaggaacgcatcctgcgcgcggcggcgatcctgctgcggctggacgtggccgacctgaccctgctgggcgacgagaccctcatccgggccaaggccgacaccctgggcctggacatcgccaaggcgcggatcgtctcgccgaccacccccgagctggtggccaccttcgccgccgagtacgcccggctgcgcgcgcacaagggcatcaccctggagctggccaccgacatcgtttccgacgtctcgtatttcggcaccatgatggtccacctggggatggccgacgggatggtcagcggggccgtgcacaccaccgcgcacaccatccggccctccttcgagatcatcaagaccgcgccgggcaccaccgtggtctccagcgtcttcctgatgtgcctggccgatcgcgtcctggtctacggcgactgcgcggtcaaccccgacccgaccgcggaacagctggccgagatcgccatctcgtccgcgcagaccgccgcgcagttcggcgtcgacccgcgggtggcgatgctgtcctactcgaccggcagttcgggatcgggcgccgacgtggagaaggtgcgcacggccaccgacatcgtgcacaccaagcggccggacctgttggtggagggcccgatccagtacgacgccgcggtcgacccgggcgtggcggtgaccaagctgccggattcgcaggtggccgggcgggccaccgtgctgatcttcccggacctgaacaccggcaacaacacctacaaggcggtgcagcgcagcgccggggcggtggccatcgggccggtgttgcaggggctgaacaagccggtcaacgacctgtcccggggcgcgctggtggccgacatcgtcaacaccgtcgccatcacggcgatccaggcgcagggggagaccgcgtga

SEQ ID NO: 1650 - DNA, 2076 bp, Brachybacterium faecium DSM 4810
gtgtatatcgccagcccggaggggatgaccggcaagtcgatggtggctttcggcctcctcgaagcgctcgcctcgcggtcggaccgcgtgggcgtgtatcgacccgtcgtgaagtcgtcgcgcacgcgcgactacgccgtcgacctgctgaccagccatcccgcggtggatcagagctacgaggacgcgatcggcgtggaccacgagctggtgctgtccgatccggacgcggcgcacgagcggatcctcgcccgccaccgcgagctcgccgagcgctacggggtgctggtggtgctcggctcggactacgacgacctcgccaaccccaccgagctcgccttcaacgccgaggtcgccgcgaacatgggcgccccggtggtggtggtcctgtccggactggaccgcagccccgatcagctcgccgcgctggccgccgtctccgtcggcgagttcggcggccaccacgcgctgccgatcgcggtggtcgtcaaccgtgcggagccggactcgctcgaggccatccgcgacgtcgtctcggcgcgcgtgcccggcccgctggtcgccgcgatccccgagaacccggtgatcctcgcccccacggtgcaggagctgaaggacgccgtgggcggcacgctgctgcagggcaatccggagtggctggaccgggtcgccgtgggcaccgtgatcgcggcgatgagcctgcccaacgtgctcagccgcctcaccgagaactgcaccgtgatcgcccccggcgaccggtacgacctgctgcccggactggtgatggcgcagcagtccggcaccttcccggcgctgtcctcgatcgtgctcaccggcgggtacgacgtgcccgaggaggtgggtcgcctgatctccggcgtgcagcaggatctgccgatcctcaccaccgagctgtccaccttcgacaccgcgctgcaggtggcgcggtcgaggggccggctggacgtgggcagcccgcagaaggtggacgccgcccgacgggccgtcgccgagcacctgccgatcccggacctgctcgcctccctcgaggtgacccgcagcgatgtcgtcacgccgatgatgttcgagttcgagctgctcgcccgggcccgcggggagaagaagaccatcgtgctccccgagggcgaggagccccggatcctcgcggcggccgaggcgatcctcgcccgcggcgtcgccgatctgatcctgctcggggacgagaacacgctgcgcgcccgggccgcccagctggggcacgacatctccgaggcgcgcgtggtctccccgcatgacgaggagcacctcgagcgctacgccgcagagtacgcgcggctgcgggcgaagaagggcgtcaccctcgagcaggcgcgggagaaggtccaggacgtctcctacttcggcaccatgatggtgcagctgggcgaggccgacgggatggtctccggcgccgcccactccacggcccacacgatccgcccctccttcgagatcatcaagacgaagcccggcgcgaagatcgtctcctcggtgttcctcatggcgctcgaggaccgcgtgctggtctacggcgactgcgccgtgaacccggatcccacggccgagcagctggcggacatcgccgtgcagtccgccgcgaccgcgcagcagttcgggatcgcgccgcggatcgcgatgctctcctactccaccggctcctccggcagcggggcggacgtcgacaaggtgcgcgaggcgacctcgctggtgcgggccgacgagcccgggctggatgtggagggcccgatccagtacgacgcggcggtggacgcctcggtcgccaagaccaagctgccggactcctcggtggccggccgtgcgacggtgttcgtgttccccgatctgaacaccggcaacaacacctacaaggccgtccagcgctccgccggggcgatcgccatcggcccggtcctgcagggcctgaacaagccggtcaacgacctctcgcgcggcgccctggtcgacgacatcatcaacacggtggtcatcaccgcgatccaggcgcaggccgagcccgccgcggccccctccgcctga

SEQ ID NO: 1651 - DNA, 2055 bp, Actinomyces urogenitalis DSM 15434
gtggcgcgcagtatctacatcgcctcacccagtgccggaaccggcaagacgaccgtggcccttggcctcatcgcctctctgaccaaggtcgtcgcgaaggtgggcgtgttccgccccttcgtggccacccgcgagcaggacccagtcctgggcctgctgctgtcccgctcaggatcgagcgcctccccggccgcctgcgtgggcgtgacctgggacgagttccgcgccgaccctgaggaagccctcacccgcatcgtcgactcctaccgggccatggcgcgcgagcacgacgtcgtcatcatcgacggctctgacttcgacgacgtcgccggcacccccgagctctccctcaacgcccgcgtggccgccaacatcggcgccccggtgctgctggtggtctctggagaccagagcgccgctgacgtgcgttcctccgcggaggtctccatcgccgagatcgccgagaaccacgcccgcacggtggcggtgctggccaaccgctgccagcccgggacccgccaggaggtggccagcgccatcgccgaggtccccggcgtcacgacgacgaccctgccggccgtccccttcctcaccgctcccacgctgcgtgagatcgccaccgccctggacgccaacctcatcgccggcgacgacgccctgctggaccgcgaagccgagtccctgctcgtgggggccatggacgtctcgcacctgctggagcgcctggtcgaggggcaggtcgtcatcaccccggctgaccgctcggccgttctcatctccctggccgccgccaacgccgcctccggcttcccgaacctggcggccctggtcctcaacggcggcttcgagccggccccctacgtcctgcagctgctcaagggactggaccagccgatcccagtactgaccaccgccctggacaccttcgaggccgccaaggtcgccggcgccgtcactggcagcctggcccacgcctcagaccgcaagatcgacgtcgccgtgaccaccttcgagcaggaggcggacctggaggcgctgctcagcgccctggaggttgagccctctgacgtggtcacgccgatcatgttccaggcagagctggttgagcgggcccgtgccgaccgccgcacgatcgtcctgcctgagcctgacgacgaccgtatcctccacgccgctgacgccatcctgcgccgcggcatctccgacgtcgtcctgctgggcgaggaggagacggtgcgcacccgcgccaccgagctgggcctggacatcgccgccgcccgtgtggtctccacctccgaccctgagctgctggagaagtacgccgccgagttcgcccgcctgcgtgccaagaagggcgtgaccctggaacaggcgcgcgagaaggtccaggacgtgtcctacttcggcacgatgatggtgcacatgggcgacgccgacggcatggtctcgggcgcggctcacaccaccgcccacacgatcgtcccctccttccagatcatcaagaccaagccaggcacctcgatcgtctcctcggtcttcctcatgctcctggaggaccgggtcctggtctacggtgactgcgccgtcaaccccgagcccaccgccgccgagctggccgacatcgccatctcctcggccgagaccgctcgccagttcggcgtcgagccccgcgtggccatgctctccttctccaccggcacctccggcaagggagcggacgtggacaaggtccgcgaggccactgagatcgtgcgagccaaggctcccgagctcgccgtggagggcccgatccagtacgacgccgcgatcgacccgaccgtggccgccaagaaggcgccgggatcggctgtggcaggtaaggccaccgtcttcatcttcccggacctgtcagccggcaacatcggctacaaggccgtccagcgctcctccggcgccgtggcgatcggcccggtgctgcagggcctgaacaagccggtcaacgacctgtcacgaggcgcgctggttgaggacatcatcaacaccgtcgccatcaccgccgtccaggcacagggctga

SEQ ID NO: 1652 - DNA, 2088 bp, Kytococcus sedentarius DSM 20547
atggtcgcctccccggaggggaacaccggcaagtccgccatcgccctgtcgctcgtggaggcggccgtcgccaccgtcgagcgggtgggcgtgttccgccccgtcgcccgcgagcaggaccggcagagcgaccccatcctgtcggccctgctgagccgcgccgggtcgagcatcgaccccgtcgatgcggtgggcgccacctacgaggacgtccacgccgacgaggacgaggcgatggcccgcatcgtgagcgcctaccaccgggtggccgagcagtccgacctggtgatcgtgctcgggtccgacttcaccgacgtcaccgggccgaccgagttctccttcaacgcccgtgtggcggccaacctctccgcgcggctggtgctggtggtccacggggacggccgcaccggggagcaggtccgcacggtggtggagatgtgcgtccacgaggcgcaggcccagcacgcctcggtgctcggcgtggtgtgcaaccgcgtcaccggggtggaccccgatgcggtgaccctcgccctggaggggctggtcgcccaggacggcaccgcggtgccggtgctggccaccatcgccgacctgcccctgctgtcggcccccacggtgcgcgacgtcatgggcgcggtggacgggacgcagctgtggggcgacgaggccgcgctggaccgcgaggtagaggacatcctggtgggcgggatgaaccccgaacacatcctggagcggttgtccgacgggcagctgtgcatcgcggcgagcgaccgggtcgagatcctgctcacgctgatcgccgcgcacacctccgaccggctgcccacgctcagcggggtggtgctcaacggcggcttcgagctgggggagcgggtgcgtgagctggtggacgggttgaacctgcgcctgcccgtcatcgagacggccggccacacctacgagaccgcacgcgccgcggcctcggtgcggggtctgctggggcaggggagcggtcgcaagaccaccgcggccctggcccacgtgggcgcccgcctcgatgcccgggccgtgctggaacagctcgacgtccggccgaccacggtggtgaccccgctgatgttccagcaccagctggtggagcgggccgcccagcaccgccgccacatcgtgctgcccgaggggtcggacgaccgcatcctgcgcgccgcgggccgggtgctgacgcgggacctggtggacctgaccatcctcggggaggtgggggccctgcagcggcgcgcccaggagctgggggtggacctctccggtgccaccctgcgcgaccccgcggacgaccccgatgccgagcggctcgcggagctgtacaccgacctgcgacggcacaagggcatgacgctggagaccgcccgcaccgtggtcaccgacgccaaccacttcggcaccctgctggtccgcgacgggcagtgcgacggcatggtcagcggcgcggcccacacgaccgcggacaccattcgcccggcattccaggtcatcggcaccgccgagggcagcaacgaggtctccagcgccttcctgatgtgcttggccgaccgcgtcctggtgttcgccgactgcgcggtgatcccggagcccacgagcgaggagctcgccggcatcgccgtggccagcgcagccacggcgcacgccttcggcatcgagccccgggtggccatgctcagctactccaccggcgagtccggctccggccgtgaggtggagaaggtgcgggaggccacggacctggtgcgcgaggccgcaccggacctgccggtggccggccccatccagtacgacgcggccgtggagccctccgtggccgcctccaagatgcccgactcgccggtcgcgggccgggccacggtgctgatcttcccggacctgaacaccggcaacaacacctacaaggccgtgcagcgcatggccggcgccctggccgtggggccgctgctgcagggcctggcccggccggtgaacgacctctcgcgcggggcgctggaggacgacatcgtgaacaccatcctcatgacggccgtgcaggcggcctccgacgacgcagggagcacctcgtga

SEQ ID NO: 1653 - DNA, 2073 bp, Streptomyces flavogriseus ATCC 33331
gtgacgcgcagcgtgtacgtgaccgggatcgaccggggagacggccgccaggtcgtcgatctgggagtcatggagctactgacgcgtcaggtcgaccgggtcggcgtcttccggccgctcgtccacgacggaccggaccgcctcttcgagctgctgcgggcccgctaccggctgtcgcagagcgcggagaccgtgttcggactggactaccaggaggcctccgcggtccaggcggagaagggcaccgacgaactggtctccctgctcgtcgaacgcttccaccaggtggcgcgcgactacgaggtcgtcctcgtcctcggcagcgacttcgccgcgacccagctgcccgacgaactggccctgaacgcccggctggcaaacgagttcggctcctcggtgatcgcggtggtcgggggcaaggaccaggacgccggatccgtacgcgccgagacgcgcaacgcctaccgtgcgtacgccggtctcggctgcgacgtcctggccatgatcgtgaaccgggtggcgtccgaggaccgcgcggacatcgcggaacggctgcggacacagctgcccgtgccgtgctcggtgctgccggacgaccccgcgctctccgcgcccaccgtctcccagatcaccaccgcgctgggcggaacggttctgctcggcgacgactcggggctggcccgggacgcgctggacttcgtgttcggcggggcgatgctgccgaacctcctgaaggccctgaccccgggctgcatggtcgtcacccccggcgaccgcgcggacctcgtcatcggctcgctcgccgcgcacagcgccggcaccccgcccatcgcgggcgtcctgctcacactgaacgagcgcccaggcgaggagatactccggctggcggcccgcctcgcaccgggcaccccggtcatcgcggtggccggcggatccttccccaccgcgggtgaactcttcgcgctggaaggcaagttgaacgcggccacgccccgcaaggcggagaccgccctcggtctcttcgaacgtcacgtggacaccggcgccctgctggagcggctctcggtggcccgcagcggccgcgtcaccccgatgatgttcgagcacgaactgctggaacaggcccgctccgaccggcgccgggtcgtcctgcccgagggcaccgaggagcgtgtactgcgggccgcggacgtcctgctccgccgcgacgtctgcgacctgaccctgctcggggacaccgacgtcatccgcaagaaggccgccgacctgggcatcgacctcgccgggacccacgtcgtcgacccgcagacctccgagctgcgccagggcttcgccgagcggtacgccgcgctgcgcgcgcaccgcggggtgacggtggagctggcgtacgacgtcgtctccgacgtcaactacttcggcaccctgatggttcaggagggtctggccgacggcatggtgtccggctcggtgcactccacggcggccacgatccggccggcgttcgagatcatcaagacgaagcccgaggcctcgatcgtctcgtcggtgttcttcatgtgcctcgccgacaaggtcctcgtctacggcgactgcgcggtcaacccggatccggacgcggagcagctggcggacatcgcggtgcagtcggcggtcaccgcgtcccgcttcggcgtggaccccaggatcgcgatgctctcgtactcgacggggacctcgggcacgggcgcggacgtcgacaaggtgcgggaggccaccgagcgggtacgcgcctcccggccggacctgaggatcgagggcccgatccagtacgacgccgcggtcgagccgtccgtcgccgcgaccaaactgccggcgtcggaggtggcgggccgggcgaccgtgctgatcttccccgacctcaacaccggcaacaacacctacaaggcggtccagcgttccgcgggcgcggtcgcggtcggcccggtgctgcaggggctgcgcaagccggtcaacgacctgtcccgcggcgcgctggtccaggacatcgtcaacaccgtggccatcacggcgatccaggcgcagagcgaggcatga

SEQ ID NO: 1654 - DNA, 2082 bp, Streptomyces griseus subsp. griseus NBRC 13350
gtggcgcgcagtgtgtacgtgaccgggatcgaccggggggacggccggcaggtcgtcgagctgggagtcatggagcttctgacgcgtcaggtggaccgggtcggcgtcttccgtccgctggtccacgacggacccgaccggctctacgaactgctgcgggcccgctaccggctctcccagagcccggcctccgtctacggcctggactaccacgaggcctccgccgtgcaggcggagaagggcacggacgaactggtctcgcggctcgtcgagcgcttccaccgggtggcccgcgagtacgaggtggtcctggtcctgggcagcgacttcgccgccacccagctcccggacgaactggcgctgaacgcccggctggcgaacgagttcggggcctcggtgatcgcggtggtcggcggcaaggggcagaccgcggagtccgtccgcgccgagacccgtaacgcgtaccgcgcctacgcgggcctcggctgcgacgtgctggccatggtggtgaaccgggtcgccgccgaggaccgggcgacgatcgcggagcggctcgcggcccggctgccggtgcccgtctccgtcctgccggacgacccggcgctctcggcgcccacggtcgcccagatcaccgcggcgctggacggcacggtgctgctcggcgacgactcggggctcgcgcgcgacgcgctggacttcgtgttcggcggggccatgctgcccaacctgctgaacgcgctgacgcccggctgcctggtggtcacccccggggaccgggcggacctggtggtgggttcgctggccgcgcacagcgcgggcaccccgcccatcgcgggcgtgctgctgaccctgaacgagcgccccggcgaggagatactcacgctggccgcccggctcgcaccggggaccccggtggtgtcggtggccggcggctccttccccaccgccggcgaactcttcgccctcgaagggaagttgaacgcggcgacgccccgcaaggcggagaccgccctcggtctgttcgagcgccatgtcgacaccggcgccctcctcgaccggatctcggtggcccgcagcggacgcgtcacaccgatgatgttcgagcacgagctgctggagcaggcccgctccgaccgcaagcgcgtggtgctgccggagggcaccgaggaacgggtgctgcgggccgccgacgtgctgctgcgccgggacgtctgcgacctcacgctcctcggcgacgtggacgtgatccgcaagaaggccgccgacctcggcatcgacctcgcggacacgcagctgatcgacccgcacacctcggagctgcggggcgccttcgccgagcggtacgccgaactgcgcgcgcaccggggggtcaccgtggagctggcgcacgacgtggtggcggacgtgaactacttcggcacgctgatggtgcaggagggcctggccgacgggatggtgtccgggtcggtgcactccaccgcggccaccatccgcccggcgttcgagatcatcaagaccaagcccgacgcgaggatcgtgtcctccgtcttcttcatgtgcctggccgacaaggtcctcgtctacggcgactgcgccgtcaacccggacccgaacgccgagcagctcgcggacatcgcggtgcagtcggcggtcacggcggcccggttcggcgtggagccccggatcgcgatgctgtcgtactccaccgggacctccggctccggcgccgacgtcgacaaggtgcgcgaggccaccgagcgggtgcgggcggagcggcccgaactgcgggtggaggggccgatccagtacgacgcggcggtcgagccgacggtcgcggccacgaagctgccggactcggaggtggcgggccaggccaccgtgctgatcttcccggacctgaacaccggcaacaacacctacaaggccgtgcagcgctcggcgggcgcggtggcggtcggcccggtgctccaggggctgcgcaagccggtcaacgacctgtcgcgcggcgcgctcgtccaggacatcgtcaacacggtggcgatcacggcgatccaggcgcagggcgaggagcgccccgcatga

SEQ ID NO: 1655 - DNA, 2085 bp, Streptomyces clavuligerus ATCC 27064
gtgacgcgcagcgtgtacgtgaccgggatcgaccgcggagacgggcggcaggtcgtcgagctgggggtcatggaactcctcacccgccaggtggaccgggtgggcgtcttccggccactggtgcacgacggacccgaccgcctgttcgagctgctgcgggcccggtaccggctcacccaggacccggccaccgtgtacgggatggactaccaggacgccgccgcgctccaggccgagaagggcaccgacgagctggtctcccggctcgtcgaccgcttccacgcggtggcccgccagtacgaggtggtcctcgtcctgggcaccgacttcgtcggcacccagctcccggacgagctggccctcaacgcccggctggccaacgagttcggcgcctccgtgatccccgtggtcggcggcaagggacagcccgccgagtccgtgcgcgccgaggcccgcaacgcccaccgcgcctacgaggccctgggtgccaaggtgctcgccctggtggtcaaccgggtcgcccccgaggagcgcgcggacatcgccgagcggctcggggcccggctccccgtcccctgctacgtcctgcccgacgagcccgcgctcgccgcccccaccgtcgcgcagatcatgcacgccctcggcgccaccgtgctgctcggcgacgactcgggcctcgcccgggacgccctcgacttcgtcttcggcggcgcgatgctgccgaagttcctcaccgccctcaccccgggctgtctggtgatcacccccggcgaccgcgccgacctggtcgtgggcgcgctcgccgcgcactccgcgggcaccccgccgatcgccggtctgctgctcaccctggacgagcggcccagcgacgagatcctggcgctggccgcccggctcgcgcccggcaccccggtgctgtccgtcccgtccaacagcttccccaccgcggcggagctgttcggcctggagggcaagctcaacgcgtcgaccccgcgcaaggccgagaccgccctcgggctcttcgagcgccatgtcgacacgggtgagctgctggcccggctctcggtcgtccgcagcggccatgtcaccccgatgatgttcgagcacgagctgctggagcaggcccgcgccgaccgccgccgggtcgtcctgcccgagggcaccgaggagcgggtgctgtgggccaccgatgtcctggtccgccgggacgtctgcgacctcaccctcctcggcgacaccgaccagatccgcaagaaggccgccgacctcggcatcgacctcaccggcgtccagctcgtcgacccgaacacctccgagctgcgccagggcttcgccgagcggtacgcgcagctccgcgcgcacaagggcgtcaccgaggagctggcgtacgacgtcgtggccgatgtgaactacttcggcaccctgatggtcgaggagggcctggccgacggcatggtctccgggtccgtgcactccaccgccgcgaccatccgccccgccttcgagatcatcaagacccgccccggcgcctcgatcgtctcctcggtcttcttcatgtgcctcgccgacaaggtcctcgtgtacggcgactgcgcggtcaacccggacccgaacgcggcccagctcgccgacatcgccgtccagtcggcggccaccgcggcccggttcggcgtggacccccggatcgcgatgctctcgtactccaccggcacctccggctccggcgcggacgtcgagaaggtgcgggaggcgaccgagctggtccggcagacccggcccgagctgcggatcgagggcccgatccagtacgacgccgccgtggagccctccgtggccgccaccaagctgcccgactccgaggtcgcgggccgggccaccgtgctgatcttccccgacctcaacaccggcaacaacacctacaaggccgtacagcgctcggcgggcgccgtggcggtcggccccgtcctccagggcctgcgcaagccggtgaacgacctctcccgcggcgcgctggtgagcgacatcgtcaacaccgtcgcgatcaccgccatccaggcgcagcccgagcgccccgcctccgtctga

SEQ ID NO: 1656 - DNA, 2100 bp, Streptomyces sviceus ATCC 29083
gtgacccgcagcgtgtacgtgaccgggatcgaccgcggcgacggccgccaggtcgtcgagctgggggtcatggagctgctgacccgccaggtcgaccgggtgggggtgttccggccgctggtgcaccacagtcccgaccggctcttcgagctgctgcgcgcccgctaccggctctcccaggacccggccaccgtctacggcctcgactaccacgaggcctccgcgctgcaggccgaacgcggcaccgacgagctggtctccacgctcgtcgaccgcttccacgtggtggcccgcgacttcgacgtcgtcctggtcctcggcaccgacttcgccgacacccagctcccggacgagctggcgctcaacgcccgcctcgccaacgagttcggcgcctccgtgatcccggtcgtgggcggccgcgcgcagcccgccgagtcggtgctcgccgagacccgtaacgcctaccgggcctacgacagcctgggctgcgatgtcctcgccatggtcaccaaccgggtgacccgggaggaccgggacaagatcgccgagcggctccgggggcggatgcccgtgccctgctatgtcgtgccggacgagcccgcgctcgccgcgcccaccgtcgcccagatcggccaggcgctcggcgcgaaggtgatcctcggcgacgactccgggctcgcacgggacgcgctggacttcgtgttcggcggcgcgatgctgccgaacttcctgaacgccctgaccccgggctgcctcgtggtcaccccgggcgaccgcgcggacctggtcgtcggctcgctcgccgcgcacagcgccgggaccccgccgatagccggtgtgctgctcaccctgaacgaggtgccgagcgacgaggtcctcaccctcgccgcccgcctcgcccccggcaccccggtgctctcggtgccgggcaacagcttccccaccgccgccgaactcttcgcgctggaggggaagctgaacgcggccaccccgcgcaaggcggagaccgcgctcggtctcttcgagcggtacgccgacaccgccgagctcgcccgccgggtctccgcgccgagcagcgaccgcctcacgccgatgatgttcgagcacaagctcctggagacggcccgctccgacaagcgcagggtcgtgctccccgagggcaccgagccgcgcgtcctgcacgcggccgaggtcctgctgcgccggggggtctgcgacctgacgctgctcggtccggtcgaccagatccgcaagaaggccgccgacctcggcatcgacctcggcggctgccagttgatcgacccggcggcctccgagctgcgggacaccttcgccgagaagtacgcggccctcagggcccacaagggcgtcacggtcgagctcgcctacgacgtagtctccgacgtgaactacttcggcaccctgatggtccaggagggcctcgccgacggcatggtgtcgggctcggtgcactccacggccgccaccatccgcccggccttcgagatcatcaagaccaagccggacgccgacatcgtctcctcggtcttcttcatgtgcctcgccgacaaggtgctggtgtacggcgactgcgccgtgaaccccgacccggacgccgtgcagctcgccgacatcgccatccagtcggcggcgacggccgagcagttcggcgtggagccgcggatcgcgatgctgtcgtactccaccggtacgtcgggctcgggcgccgacgtcgacaaggtgcgggaggccaccgagctggtacggcagcggcggcccgacctcaagatcgaggggccgatccagtacgacgccgcggtcgagccgaccgttgcggagaccaagctgccgggctccgaagttgcggggcaggccagcgtgttgatcttccccgacctcaacacgggcaacaacacctacaaggccgtgcagcgttcggccggggcgatcgccgtcggcccggtgttgcagggcctgcgcaagcccgtcaacgacctgtcccggggcgcgctggtctcggacatcgtcaacaccgtcgccatcacggcgatccaggcccagaacccgaccgtcgcgacagagaaggctgcccagctgtga

SEQ ID NO: 1657 - DNA, 2103 bp, Streptomyces griseoflavus Tu4000
gtgacccgcagcgtgtacgtgaccggtatcgaccgcggcgacggccgccaggtcgtcgagctcggggtcatggagctcctgacccggcaggtcgaccgggtgggggtcttccgtccgctggtgcacgacgggcccgaccgcctcttcgagctgctgcgggcccgctaccggctcacccaggacccggcgaccgtctacggcctcgactaccacgaggcgtccgcgctgcaggccgagcggggcacggacgagctggtgtccaccctcgtcgagcggttccaccgcgtcgcccgcgactacgacgtcgtgctcgtcctcggcaccgactacgccgacacccagctccccgacgaactgtcgctgaacgcccggctcgccaacgagttcggcgcctcggtgatcccggtggtgggcggccgccggcagaccgccgagtcggtgcgcgccgagacccgcaacgcctaccgcgcctacgccaccctgggctgcgacgtgctcgccatggcggtcaaccgggtcgcccgcgacgaccgggacgagatcgccgagcggctcaccaaccggctgccggtgccctgctacgtctttcccgacgagccggcgctctccgccccgaccgtctcccagatcgcgcacaccctcggcgcgaaggtggtgctcggcgacgactccgggctggcccgcgacgcgctggacttcgtcttcggcggcgcgatgctgccgaacttcctcgccgccctgaccccgggctgtctggtggtcacccccggcgaccgcgccgacctggtcgtcggcgcgctggccgcgcacagcgcgggcaccccgccgatagccggggtgctgctcaccctgggcgaggtgccggacgaggacatcctcaccctgtcggaccggctcgcccccggcaccccggtgctctcggtgcccggcaacagcttccccaccgccgagcagctcttctccctggagggcaagctcaacgcggccaccccgcgcaaggcggagcgggccctcggcctcttcgagcggtacgccgacacctccgacctcaccaagcgggtctccgcgcccagcagcgaccgtgtcaccccgatgatgttcgagcacaagctgctcgaacaggcccgctccgacctgcgccgggtggtgctccccgagggcgccgaggagcgggtgctgcacgccgcggaggtgctgctgcgccggggcgtgtgcgagctgaccctgctcggcgacgtcgacctgatccgcaagaaggccgccgacctgggcgtcgacctcggcgacagccggctgatcgacccggccacctccgagctgcgggactccttcgccgagaagtacgcggcgctgcgcgcccaccggggggtcaccgtggagctggcctacgacgtcgtctcggacgtgaactacttcggcacgctgatggtgcaggagggcctcgccgacggcatggtgtccggctcggtgcactccacggccgcgacgatccgtccggcgttcgagatcatcaagaccaagcccgacgcggacatcgtctcctccgtcttcttcatgtgcctggccgacaaggtgctggtctacggcgactgcgcggtcaacccggacccggacgccgagcagctcgccgacatcgccgtgcagtccgcggtgacggcggcgcgcttcggggtggagccgcggatcgcgatgctgtcgtactcgacgggcacgtccggttccggcgccgacgtcgacaaggtgcgcacggccaccgagctggtgcgctcgcgccggcccgatctgcggatcgaggggccgatccagtacgacgcggccgtggagccgtcggtcgcggcgaccaaactgccgggctcggaggtcgcggggcaggcgacggtgctgatcttccccgacctgaacaccggcaacaacacctacaaggccgtgcagcgctcggccggcgccatcgccgtcggcccggtgctccaggggctgcgcaagccggtcaacgacctgtcccgcggcgccctcgtccaggacatcgtgaacaccgtcgccatcacggcgatccaggcccagtcccccgccccggtcccgagcgagaaggcagccgtccagtga

SEQ ID NO: 1658 - DNA, 2103 bp, Streptomyces ghanaensis ATCC 14672
gtgacccgcagcgtgtacgtgaccggcatcgaccgcggcgacggccgccaggtcgtcgagctgggtgtcatggaactcctgacccggcaggtcgaccgggtgggcgtcttccgtcccctggtgcacgacggacccgaccgcctcttcgaactgctgcgcgcccgctaccggctcacccaggacccggcgaccgtctacggcatggactacccggaggcgtccgcgctccaggccgagcggggcacggacgagctggtgtccgccctcgtcgaccggttccaccgggtcgcccgcgactacgacgtcgtcctcgtcctcggcaccgactacgccgacacccagttcccggacgaactgagcctgaacgcccggctcgccaacgagttcggcgcctcggtgatcccggtcgtgggcgggcggaagcagaccgcggagtcggtgcgcgccgagacccgcaacgcctaccgcgcctacgacaccctgggctgcgacgtgctcgccatggtggtcaaccgggtcgcccgcgaggaccgggacgagatcgccgagcggctctcctcccggctgcccgtgccctgctacgtcctgccggacgagccggcgctgtccgccccgaccgtctcgcagatcgcgcacaccctgaacgcgaaggtggtgctcggcgacgactccgggctggcccgcgacgccctcgacttcgtcttcggcggcgccatgctgcccaacctcctcgccgccctgaccccgggctgcctggtggtcacccccggcgaccgcgccgacctggtcgtcggctcgctcgccgcgcacagcgccggtaccccgccgatcgccggggtgctgctcaccctggacgaggtccccggcgacgacatcctcaccctcgccgcccggctcgcccccggcaccccggtgctgtcggtgtccggcaacagcttccccaccgccgagcagctgttctccctggagggcaagctgaacgcggccaccccgcgcaaggcggagaccgcgctcggcctcttcgagcggtacgccgacaccgcggagatcgaacggcgggtctccgcgcccagcagcgaccgggtgacgccgatgatgttcgagcacaagctgctcgaacaggcccgctccgacctgcggcgggtcgtgctccccgagggcgccgaggagcgggtgctgcacgcggccgaggtgctgctgcgccggggcgtgtgcgagctgaccctgctcggtccggtcgaccccatccgcaagaaggccgcggacctcggcatcgacctcggcgacacccagctgatcgacccggccacctccgagctgcgcgactccttcgccgagaagtacgcggccctgcgcgcccaccggggcgtgaccgtggagctggcctacgacgtcgtctccgacgtcaactacttcggcacgctgatggtgcaggagggcctggccgacggcatggtgtccggttcggtgcactccaccgccgcgaccatccggccggcgttcgagatcatcaagacccgcgaggacgcccggatcgtctcctccgtcttcttcatgtgcctggccgacaaggtcctcgtctacggcgactgcgcggtcaacccggacccggacgcggagcagctggccgacatcgccgtgcagtcggcggtcaccgccgcgcggttcggggtggagccgcggatcgcgatgctgtcgtactcgacgggcacctccggctccggcgccgacgtcgacaaggtgcgcgaggcgaccgagctggtgcgcgcgcgccgtcccgacctcaagatcgaggggccgatccagtacgacgcggccgtggagccctcggtcgcggcgaccaagctgccggactccgaggtcgccgggcaggccaccgtgctgatcttccccgacctgaacaccggcaacaacacctacaaggccgtgcagcgctcggccggcgcgatcgccgtcggcccggtgctccagggcctgcgcaagccggtcaacgacctgtcccggggggccctcgtccaggacatcgtcaacaccgtcgccatcacggcgatccaggcccagtcccccgcgtcgtccccgagcgagaaggcagccgccccgtga

SEQ ID NO: 1659 - DNA, 2103 bp, Streptomyces viridochromogenes DSM 40736
gtgacccgcagcgtgtacgtgaccggcatcgaccgcggcgacggacggcaggtcgtcgaactgggggtcatggagctcctcacccggcaggtggaccgggtcggcgtcttccgccccttggtccacgacgggcccgaccgcctcttcgagctgctgcgcgcacgctaccggctcgcccaggaccccgcgaccgtgtacggcatggactaccacgaggcgtccgccctccaggccgaggccggcacggacgagctggtgtccacgctcgtcgaccgcttccacctggtcgcccgggactacgacgtcgtcctggtcctcggcaccgacttcgccgacacccagctcccggacgagctgtcgctcaacgcccggctggcgaacgagttcggcgcgtcggtgatcccggtcgtcggcggccgcaagcagagcgtcgagtccgtgctcgccgagacgcgcaacgcctaccgcgcctacgacaccctcggctgcgacgtcctggccatggtcaccaaccgggtggcccctgaggaccgcgacgagatcgccggccagctcggctcccggctccccgtgccctgttacgtgctgcccgacgagcccgcgctgtcggccccgaccgtctcgcagatcagccacgccctcggcggcaaggtggtgctcggcgacgactcgggcctggcccgggacgtgctcggtttcgtcttcggcggcgcgatgctgccgaacttcctcggcgccctgaccccgggctgcctggtcgtcacccccggcgaccgggccgacctggtcgtcggctcgctcgccgcacacagcgccggcaccccgccgatcgcgggcgtgctgctcaccctggacgaggtgcccggcgacgacatcctcaccctcgccgaccgcctcgcccccggcaccccggtgctgtcggtggccggcaccagcttccccaccgccgagcagctgttctccctggagggaaagctgaacgcggccaccccgcgcaaggcggagcgggcgctcggcctgttcgagcggtacgccgacaccgccggcctcgcacgccgcgtctccgcgccgagcagcgatcgcgtcacgccgatgatgttcgagcacaagctgctggagcaggcccgctccgacctgcgccgcgtcgtgctgcccgagggcaccgaggagcgtgtgctgcacgcggccgaggtgctgctgcgccggggcgtgtgcgagctgacactgctcggcccggtcgaccggatccgcaagaaggccgccgacctcggcatcgacctgggcgagtcccagctgatcgaccctgccgcctccgacctgcgcgacgccttcgcggagaagtacgcggcgctgcgcgcccaccgcggcgtcaccgtggagctggcgtacgacgtcgtctcggacgtgaactacttcggcaccctcatggtgcaggagggcctcgccgacggcatggtgtcggggtcggtgcactccacggccgcgaccatccgcccggccttcgagatcatcaagaccaagccggacgccgacatcgtctcgtcggtgttcttcatgtgcctggccgacaaggtgctcgtctacggcgactgcgcggtcaaccccgacccgaacgccgagcagctcgccgacatcgccatccagtcggcgacgacggccgcgcaattcggtgtggagccgcgcatcgccatgctgtcgtactccacgggcacgtccggctccggcgccgacgtcgacaaggtgcgcgaggccaccgggatcgtccgcaggctgcggcccgacctgaggatcgagggcccgatccagtacgacgccgcggtggagccgtcggtggcggcgaccaaactgcccggctccgaggtcgccgggcaggcgagtgtgctgatcttccccgacctgaacaccggcaacaacacctacaaggccgtgcagcgctcggccggcgccatcgccgtcggcccggtgctccaggggctgcgcaagccggtcaacgacctgtcccggggcgccctcgtccaggacatcgtgaacaccgtcgccatcacggcgatccaggcccagtcccccgccccgtccccgagcgagaaagcaaccgcccagtga

SEQ ID NO: 1660 - DNA, 2094 bp, Streptomyces lividans TK24
gtgacgcgcagcgtgtacgtgaccggcatcgaccgcggcgacggccgccaggtcgtcgagctgggggtcatggaactgctgacccggcaggtcgaccgggtcggcgtcttccgtcccctggtgcacgacgggccggaccggctcttcgaactgctgcgcgcccgctaccggctctcgcaggaccccgcgacggtctacggcatggactaccaggaggcctccctcctccaggcggaacagggcgtggacgagctggtgtccgcgctggtcgaccgcttccacctggtcgcgcgggactacgacgtcgtcctggtcctgggcaccgactacgccgacacccagttcccggacgagctgtccctgaacgcgcggctcgccaacgagttcggcgcctcggtcctccccgtcgtcgggggccgcaagcagaccgccgactcggtgctggccgagacccacaacgccttccgtgcctacgacggcctcggctgcgacgtgctcgccatggtgaccaaccgggtcgcgcgcgaggaccgggacgagatcgccgagcggctcgcgcaccggctgccggtgccgtgctgggtggtaccggacgagcccgccctgtcggcgccgacggtctcccagatcgcgcacgccctgggcgccgagatcgtcctcgccgacgactccgggctcgcccgcgacgcgctggacttcgtcttcggcggggccatgctgcccaacctgctggccgcgctgaccccgggctgcctggtcatcacgcccggcgaccgcgccgacctggtgatcggcacgctggccgcgcacagcgccggcaccccgccgatagccggggtgctgctgacgctgaacgaggtgcccggcgagggcatcctcaccctcgccgcccggctggcccccggcacgccggtgctctcggtgacgggcaccagctttcccaccgcggaacggctcttctccctggagggcaagctgggcgcggccaccccgcgcaaggcggagaccgccctcggcctcttcgagcggtacgtcgacaccgccgagctgaacaagcgggtctccgcgcccagcagcgaccgcgtcacgccgatgatgttcgagcacaagctgctcgaacaggcccgctccgacctgcgccgggtcgtcctgccggagggcaccgaggagcgggtgctgcacgcggcggaggtgctgctgcggcgcggggtgtgcgagctgacccttctcggccccgtcgagcagatccgcaagaaggccgccgacctcggcatcgacctcggcggcgccgagctgatcgacccggccgccagcgagctgcgcgactccttcgccgagaagtacgccgccctgcgcgcccacaagggcgtgaccgtggagctggcgtacgacgtggtctcggacgtgaactacttcggcacgctgatggtgcaggaggggttcgccgacggcatggtgtcggggtcggtgcactcgacggcggcgaccatccggcccgccttcgagatcatcaagaccaagccggacgcggccatcgtctcctcagtcttcttcatgtgcctggccgacaaggtgctggtctacggcgactgcgcggtcaacccggacccggacgcggagcagctggccgacatcgcgacgcagtccgcctcgaccgccgcgcagttcggggtggagccgcggatcgcgatgctgtcgtactcgaccggcacgtccggttccggcgcggacgtcgacaaggtccgcgaggccaccgagctggtccgctcgcgccgcccggacctcagcgtcgaggggccgatccagtacgacgcggcggtcgagccgtcggtcgccgcgaccaagctgcccggctccgcggtcgccgggcaggccagcgtgctgatcttccccgacctgaacaccggcaacaacacctacaaggcggtgcagcgctcggccggcgccatcgcggtcggcccggtgctccagggcctgcgcaagccggtcaacgacctgtcccggggcgcgctcgtgcaggacatcgtcaacaccgtcgccatcacggcgatccaggcccagcagtccccgaccgagaaggcgtccgcccagtga

SEQ ID NO: 1661 - DNA, 2091 bp, Streptomyces avermitilis MA-4680
gtgacgcgcagcgtgtacgtgaccggaatcgaccgcggcgacggccgccaggtcgtcgagctgggggtcatggagcttctgacccgccaggtcgaccgggtgggggtgttccgcccgcttgtgcacgacggtcccgaccgcctcttcgagctgctgcgcgcccgctaccggctcgcccaggacccggcgaccgtgtacggcatggactatcacgaggcgtccgcgctccaggccgagcaggggaccgacgagctgatgtccacgctggtcgaccggtttcatctggtcgcgcgcgactacgacgtcgtcctcgtcctcggcacggacttcgccgacacccagttccccgacgagctggccctcaacgcccgcctcgcgaacgagttcggcgcggccgtgatccccgtggtcggcgggcgcgggcagaccgccgagtcggtgcgcgccgagacccgtaacgcctaccgcgcgtacgaggggctcggctgcgacgtcctcgccatggtggtgaaccgggtggcccgagaggaccgcgaggaactggccgcacggctcgattcccttctcgccgtgccctgttacgtactcccggacgagccggcgctctccgcgccgacggtcgcgcagatcacgcacgccctgggcggcaaggtgctcctcggcgacgactcggggctcgcccgggacgccctcgacttcgtgttcggcggtgcgatgctgccgaacttcctcaacgcgctgaccccggggtgtctggtggtcaccccgggcgaccgcgccgacctggtggtgggcgcgctcgccgcgcacagcgcgggcaccccgccgatagccggtgtgctgctcaccctcgacgagcggcccagcgacgaggtcctcaccctggccgcccggctcgcgcccggcaccccggtggtctcggtggccggcaccagcttccccaccgcggccgaactgttctccctggaggggaagctgaacgcggcgacgccccgcaaggcggagaccgcactcggcctgttcgagcggtacgtcgacaccggcgacctgctgaagcgggtgtccgccccgagcagtgaccggctcacgccgatgatgttcgagcacaagctcctggagcaggcccgctccgacaagcggcgcgtcgtgctgcccgagggcaccgagacgcgcgtcctgcacgccgccgaggtgctgctgcgccggggcgtgtgcgatctgacgctgctcggcccggtcgaccagatccgcaagaaggccgccgacctgggcatcgatctgggcggctcccagctgatcgacccggtgacctcacagctgcgggactccttcgccgagaagtacgcccagctccgggcccacaagggggtctcggtggagctggcctacgacgtcgtcgccgacgtcaactacttcgggacgctgatggtgcaggaggggctcgccgacggcatggtgtcgggctccgtgcactccacggccgccaccatccggcccgcgttcgagatcatcaagaccaagccggacacgaagatcgtgtcgtccgtcttcttcatgtgcctcgccgacaaggtgctggtgtacggcgactgcgcggtcaaccccgacccgaacgccgagcagctgtgcgacatcgccgtccagtcggccgccaccgcccggcagttcggggtggagccgcggatcgcgatgctgtcgtactcgacgggtacgtccggttcgggcgccgacgtcgacaaggtgcgcgaggcgacggaactggtccggctgcgccgcgacgacctgaagatcgagggaccgatccagtacgacgccgccgtcgagccgtccgtcgcggcgaccaagctgccgggctcggacgtcgccgggcaggcgtccgtgctgatcttcccggacctcaacaccggcaacaacacctacaaggccgtgcagcgctcggccggcgcgatcgccgtcggcccggtcatgcagggtctgcgcaagcccgtcaacgacctgtcccgcggcgccctcgtgcaggacatcgtgaacaccgtcgccatcaccgcgatccaggcccagtccccccacgagaaggcgaccgcccagtga

SEQ ID NO: 1662 - DNA, 2106 bp, Streptomyces scabiei 87.22
gtgacgcgcagcgtgtacgtgaccgggatcgaccgcggcgacggccgccaggtggtcgagctgggggtgatggagcttctcacccgccaggtcgaccgggtgggggtgttccggccgctgctgcaccacgggccggaccggctgttcgatctgctgcgcgcacgataccggctcacccaggacccggcgaccgtgtatggcatggactaccacgaggcgtccacgctccaggcccagcacggcacggacgagctggtgtcggcgctcgtcgaccgcttccacgccgtcgcgcgcgacttcgacgtcgtcctcgtcctcgggaccgacttcgccgacacccagttcccggacgagctctccctcaacgcccggctcgccaacgagttcggcgcctccgtcatccccgtcgtcggcgggcgggggcagaccgccgagtccgtggccgccgagacccacaacgccttccgcgcgtacgacggcctcggctgtgacgtgctcgccatggtcgtcaaccgggtcgcgcccgccgaccgggacgacatagccgagcggctcggggactcccggctgccgctcccggcgccctgttacgtcctgcccgacgagccggctctctccgcgcccaccgtcgcccagatcacccacgccctcggcggcacggtgctcctcggcgacgactcgggcctcgcccgtgacgcgctgaacttcgtcttcggcggggccatgctgcccaacttcctgaacgccctgaccccgggctgtctggtcgtcacccccggcgaccgcgcggacctggtcgtcggcgccctcgccgcccacagcgccggcaccccgccgatcgccggtgtgctgctcaccctgaacgagcggcccagcgaggaggtcctgaccctcgccgcgcggctcgcgcccggcacccccgtggtcgccgtcgagacgggttccttcctcaccgcctccgaactgttctccatggagggcaagttgagcgcggtgaccccgcgcaaggcggagaccgcgctcggcctgttcgagggttacgtcgacaccgccgagctgcggagcagggtctccgcgccgagcagcgaccgggtcacgccgatgatgttcgagcacacgctcctcgaacaggcccgctccgacaagcgccgtgtcgtgctgcccgagggcaccgaggagcgcgtcctgcacgccgccgaggtgctgctgcggcgcggggtctgcgacctcaccctgctcggcccggtggagcagatccgcaagaaggccgccgacctgggcatcgacctgggcgagagccagctggtggacccggcgacctccacgtggcgggacaggttcgccgagaagtacgcccagttccgcgcccacaagaacatcagcgtcgagctggcctacgacgtggtgtcggacgtgaactacttcggcacgctcatggtccaggaggggctcgccgacggcatggtgtcggggtccgtgcactccaccgccgccaccatccggcccgcgttcgagatcatcaagacccggccggacgcggacatcgtctcgtccgtcttcttcatgtgtctcgccgacaaggtgctggtctacggggactgcgcggtcaacccggatccggacgccgagcagctcgccgacatcgccgtccagtcggccgccaccgcacggcagttcggggtcgaaccgcggatcgcgatgctgtcgtactccacggggacctccgggtcgggcgccgacgtcgacaaggtgcgccgtgccaccgagctggtgcgcgcgcggcgccccgatctgctgatcgaggggccgatccagtacgacgccgccgtggagccgagcgtcgcggcgacgaagctgccggactccgaggtcgcgggccaggcgacggtgctggtcttcccggacctcaacaccggcaacaacacctacaaggccgtccagcggtcggcgggcgcgctcgcggtgggcccggtgctgcaggggctgcgcaagccggtcaacgacctgtcccggggagcgctcgtccaggacatcgtcaccacggtcgccatcacggcgatccaggcccagacctccgccgccgccctcggcgaccccggcaagtga

SEQ ID NO: 1663 - DNA, 2076 bp, Streptomyces albus J1074
gtggcacgcagcgtctacgtcaccgggaccgaccggggcgacggccggcaggtcttcgagctgggtctcatggaactgctgacccgccgggtcgaccgggtgggggtgttccggccgctggtgcacgacggacccgaccgcctcttcgaggtgctgcgcggccgctaccggctcagccaggacccggccaccgcacacggcatcgactaccgcagagcggcgggcatccaggccgagcagggcaccgacgccctggtctcgcagctcgtcgaccgctacctcgcggtcgcccgggactacgaggtggtgctggtcctcggcaccgactacgccgacacccagctcccggacgagctggcgctcaacgcccgcctcgccaacgagttcggcgcctcggtgctgccggtggtcggcggccggtcgcagagcgccgagtcggtccgcgccgaggcccgcaacgcctaccgcgcctaccacgcgctcggctgcgacgtgctggccctgggcgtcaaccgggtcgccgccgaggaccgcgacgtggtcgcccagcggctgggggcccgcctccccgtgccctgctacgtcctccccgacgaccccgcgctctccgcgccgaccgtccggcagatctcccgggcgctggacggaacggttctgctgggcgacgacgccggcctcgcccgggacgtcctcgacttcgtcttcggcggcgccaccctccccaccttcctgcacgccctcaccccgggctgcctggtggtggcccccggcgaccgggccgacctggtggtgggggcgctggccgcgcacagctccgggaccccgccgatcgccggggtgctgctgacgctgggcgagcggccggaccccgaggtgctgcggctggccgcgaaggtggcgccgggcacgccggtggtctccgtaccgggcaacagcttcccgaccgcgacccggctcttcaccctggaagggcggctcgacgcggcgacgccgcgcaaggcggagacggcgctcggcctcttcgaagactgggtggacacgggcgagctgctggaccggatctcggtcggctccaccgaccgggtcacgccgatgatgttcgagcacaagctgctggagcgggcccgcgccgaccgccgccgggtggtgctgcccgaggggctggaggagcgggtgctgcgcgccgccgacgtgctgctgcgccgctcggtctgcgacctcaccctgctcggcccggtcgacgcgatccgcaagaaggccgccgacctgggggtggacctcggcgccgccgagctgatcgacccgcaggagtcggagctgcgcaagcggttcgccgagcggtacgcccagctccgcgcccacaagggcgtctcggtggagctggcgtacgacgtggtcgccgacgtcaactacttcggcacgctgatggtcgaggaggggctggccgacggcatggtctccggctccgcccactccacggcggccaccatccgcccggccttcgagatcatccgcacccgcccggacgccaccctggtctcctcggtcttcttcatgtgcctcgccgaccgggtgctggtctacggcgactgcgcggtcaaccccgacccgaacgcggtggagctggccgacatcgccgtccagtcggcgctgaccggcgcccgcttcggcgtcgacccgaagatcgcgatgctctcgtactcgaccggcagctccggttcgggcgccgatgtggagaaggtccgcgaggcgaccgcgctggcccgcgaacgccggcccgacctgctgatcgagggcccgatccagtacgacgcggcggtcgagccgacggtggcggcggccaagctgcccggctccgaggtggcgggccaggccaccgtgctgatcttcccggacctcaacacgggcaacaacacgtacaaggcggtgcagcggtcggccggggcggtggcggtcgggccggtcctgcagggtctgcgcaagccggtcaacgacctctcccggggcgcgctcgtccaggacatcgtcaccaccgtcgccatcaccgccgtccaggcccaggagagcgacgcgtga

SEQ ID NO: 1664 - DNA, 2085 bp, Streptomyces sp. Mg1
gtgacgcgcagcgtgtacgtgaccggtatcgagcggggtgacggccggcaggtcgtcgagctggggatcatggagctgctgacccgccggacgggccgggtcggtgtctaccgtccactgctgcacgacgcgccggaccggctcttcgacctgctcaaggcgcgctaccggatcgaccaggacgcggcgaccgcgtacggcatggactacgaggaggcctcggcgatcgctgcggagaagggtaccgacgagctggtctcccggctcgtcgaccgcttccaccgggtggcccgcgactacgaggtcatgctggtgctcggcaccgactacgccgacaccaacctccccgacgagctggcgttcaacgcccgcctcgccaacgagctgggggccgtcgtcgtgcccgtcgtgggcggtacgaagcggcccgcggagtcggtgcgcgccgaggcccgcaacgcctaccgggcgtacgagagcctgggctgccacgtcgtcgcgatgatggtcaaccgggtggcctccgaggaccgcgacgcgatagccgagcggctcgccgcccgcctcccggtgccctgctacgtcctgccggaggacaagtcgctgtccgcgccgaccgtcgccgagatcaccacggcgctcggcggcgaggtgctcctcggcgacgacgccgggctggcccgcgacgcgctggacttcgtcttcggcggcgccatgctgccgaacttcctgagcgccctgacccccggctgcctggtggtgacccccggcgaccgctccgatctggtgatcggcgcgctggccgcgcacacctccgggaccccgccgatcgcgggggtgctgctgaccctgaacgagcgcccgggcgaggacatcctgacgctggcctcgaagctggcgccgggcaccccggtggtctcggtggccggcaacagcttcccgacggccaccgagctcttctcgctgcagagccggctgaactccgccaccccgcgcaagctggagacggcgctcggtctgttcgaggggcacgtggacaccgccgagctgcgcgacctcttgtcggtggcccgctcggagcgggtcacgccgatgatgttcgagcacgagctgctggagcgggcccgctccgagcgccgccgggtcgtgctgcccgagggcaccgaggagcgggtgctgcgcgccgcggacgtggtgctgcgccggggggtctgcgatctgaccctgctcggcgagacccaggcgatcctgaagaaggccgccgacctcggcatcgacatctcgggggcccagctgatcgacccggcggcctcgccgctgcgggaacggttcgccgagtactacgcgcaggcccgcgcccacaagggcatgaccgtcgagctggcgggcgacgtggtcaccgacgccaactacttcggcaccctgatggtgcaggaggggctggccgacggcatggtctccggctcggtgcactccaccgccgccaccatccgcccggccttcgagatcatcaagaccaagcccgaggcctcgatcgtctcctcggtcttcttcatgtgcctggccgacaaggtcctggtctacggggactgcgcggtcaacccggacccggacgccgagcagctcgcggacatcgccgtccagtcggcggccaccgcggcggccttcggggtcgagccgcggatcgcgatgctctcgtactcgaccggcacctcgggcagcggggccgacgtggacaaggtccgcaaggcgaccgagatcgtccgggcccggcaccccgatctgctgatcgaggggccgatccagtacgacgcggccgtggagccctcggtggccgcgaccaagctgcccggttccgaggtggccggccgggcgaccgtgctgatcttccccgacctcaacacgggcaacaacacgtacaaggccgtgcagcgttcggcgggcgccgtcgcggtcgggccggtgctccagggcctgcgcaagccggtcaacgacctctcgcgcggcgcgctcgtccaggacatcgtcacgaccgtggcgatcaccgcgatccaggcgcagggcgcgccggcccccaccgcctga

SEQ ID NO: 1665 - DNA, 2088 bp, Streptomyces sp. C
gtgacgcgcagcgtgtacgtgaccggtatcgagcggggagacggccggcaggtcgtcgagctgggcatcatggagctcctgacccgccagacgggccgggtcggcgtgtaccgccccctgctgcacgacgggccggaccggctcttcgacctgctgcgggcccgctaccggctcgaccaggacgccgcgacggcgtacggcatggagtaccacgaggcctccgccatcctcgccgagaagggcaccgacgagctggtctcccggctcgtcgaccgctaccaccgggtggcccgggactacgaggtcatgctggtgctcggcaccgactacgccgagaccaacctgcccgacgagctcgcgctgaacgcccgcctcgccaacgagctgggcgcggtcgtcgtccccgtcctcggcggcgccaagcagcccgccgaggccgtgcgcgccgaggcgcgcaacgcccaccgggcctacgagagcctgggctgccacgtcgtggcgatggtcgtcaaccgggtggcccccgaggaccgcgacgccatagccgagcggctcgccgcccgcctccccgtgccctgctacgtcctgcccgacgacaagaacctgtccgcccccaccgtcgcccagatcacccgggcgctcggcggcgaggtgctcctcggcgacgacgccggcctcgcccgcgacgccgtggacttcgtcttcggcggcgccatgctgcccaacttcctgaacgccctgacccccggctgcctcgtcgtcacccccggcgaccgggccgacctggtcgtgggggcgctcgccgcgcacgcctcgggcaccccgccgatcgcgggcgtgctgctgaccctgaacgagcgcccgtccgctgacgtcctcaccctggcctcgaagctcgcccccggcaccccggtggtctcggtggccggcaacagcttcccgaccgccgccgaactcttctcgctgcagagccggttgaactccgcgaccccgcgcaagctggagaccgcgctcggcctcttcgagcggcacgtggacaccgccgaactgcgcgggctgctgtcggtggcccgctcggagcgcgtcaccccgatgatgttcgagcacgagctgctggagcgggcccgttccgagcggcgccgcgtggtgctgcccgagggaaccgaggagcgggtgctgcgcgccgcggacgtcgtgctgcgccggggggtgtgcgacctgaccctgctgggcgaggagcaggccatcctgaagaaggccggcgacctgggcgtcgacatctcggccgcgcagctgatcgacccggcgacctcccccctgcgggaacgattcgccgagtactacgccaaggcccgcgcgcacaagggcatgaccgtcgagctggcccacgacgtggtcaccgacgtcaactacttcggcaccctgatggtccaggagggcctggccgacggcatggtctccggctcggtgcactccaccgccgccaccatccgccccgccttcgagatcatcaagaccaagcccgaggcctcgatcgtctcctccgtcttcttcatgtgcctggccgaccaggtcctcgtctacggcgactgcgccgtcaacccggaccccgacgccgcccagctggccgacatcgccgtgcagtcggcggccacggccgcggccttcggcgtcgacccccggatcgcgatgctctcgtactccacgggcacctccggctccggcgcggacgtggagaaggtccgcaaggccaccgaggccgtccgcgcgcagcgtcccgacctgctcatcgagggccccatccagtacgacgccgccgtggagccctcggtcgccgcgaccaagctgcccggctccgaggtggccggccgggcgagcgtgctgatcttcccggacctgaacacgggcaacaacacgtacaaggcggtgcagcgttcggccggcgccgtcgcggtcggcccggtgctccagggcctgcgcaagccggtcaacgacctctcgcgcggcgcgctcgtccaggacatcgtcaccaccgtggcgatcaccgcgatccaggcgcagtcgcagtcccggccccaggcccagtga

SEQ ID NO: 1666 - DNA, 2097 bp, Streptomyces hygroscopicus ATCC 53653
gtgacgcgcagcgtgtacgtgaccgggatcgaacggggtgacggccgccaggtcgtcgagctgggggtcatggagctgctgacccgccatgtcgaccgggtcggcgtcttccgtcccctggtgcacgacgaccccgaccgcctcttcgacctgctgcgggcccgctaccggctcagccagccgcccgcctcggcgagcggtatgagctacgaggaggccgccgccctccaggccgaggagggctccgacgagctggtgtcgcgactggtcaaccgcttccacgaggtgtcccgcgagtacgagtacgtcctcgtcctgggcagcgactacgccgacaccagcctcccggacgagctggggctgaacgcccggctcgccaacgagttcggcgcctcggtgatcaccgtcgtcggcggccaggaccagaacgccgaggccgtcggcgccgaagcccacaacgcctaccgcgcgtacgaggcgcagggctgcgacgtcgtcgccgtcgtcgtcaaccgggccgtgccggacgaccgcacggagatcgccgagcggctggccacccggctcccggtgcccggctacgtcctccccgaggacggggcgctgtcggcacccaccgtctcccagatcgtgcgcaccctcggcgccgatgtactgctcggcgatcacgccggactctcccgggacgtccgggacttcgtcttcggcggcgcgatgctgcccaacttcctgcccgctctcaccgagggctgtctcgtggtcacgcccggcgaccgcgcggacctgatcgtcggctcgctcgccgcgcacagcgcgggcgcccccgcgatcgccggggtgctgctcaccctggacgagcggccgggaccggacatcctggcgctggcgtcccggctggcccccggcaccccggtggcggcggtggcgggcggctccttcccgaccgcggccgagctgttcgccatcgagggcaagctgaacgcgggcgcgccgcgcaaagccgagaccgccctcggcctcttcgagcgccatgtggacaccgccgcgctgaccgaccgcatcgcggtggcccgctccggccgggtcaccccgatgatgttcgagcacgagctgatcgagcggtcccgctccggacgccgccgggtggtgctgcccgagggcaccgaggagcgggtgctgcgcgccgccgacgtcctgctgcgccgcgatgtgtgcgacctcacactgctgggcgaggaggacacgatccgcaagcgcgccgccgaactgggcatccagctcgccgaggcgcagatcgtcgatccgcagacctcgccgctgcgggagcgcttcgcggagatctacgccaagctgcgcgcccacaagggcgtcgatcacgagctggcgtacgacgtggtcgccgacgtctcgtacttcggcaccctcatggtccaggagggcctggccgacggcatggtctcgggcgcggtgcactccaccgcggcgaccatccggcccgcgttcgagatcatcaagaccgcgccgggcgcgcagatcgtctcgtcggtcttcttcatgtgcctggccgaccgggtgctggtgtacggcgactgcgcggtcaacccggatccgggcgccgagcagctggccgacatcgccatccagtcggcgaccacggccgcccggttcggggtggagccgcggatcgcgatgctgtcgtactccaccggcacctccggctccggcgcggacgtcgacaaggtgcgcaaggcgaccgacctggtgcgcgagcgccgccctgacctgctggtcgagggcccgatccagtacgacgccgcggtggacgcggcggtcgctgcgaccaagctgccggactccgaggtggcgggcaaggccaccgtgctgatcttcccggacctcaacaccggcaacaacacctacaaggccgtgcagcgctcggcgggcgccgtcgcggtcggcccggtgctccagggtctgcgcaagccggtgaacgacctgtcccgcggggcactcgtgcaggacatcgtgaacaccgtctcgatcaccgcgatccaggcccagtcccagacgcccccgaccaccccggagtcccggtga

SEQ ID NO: 1667 - DNA, 2091 bp, Streptomyces sp. SPB74
gtgtcgcgcagtgtctatgtgaccgggaccgaccggggggacgggcggcaggtcgtcgagctgggggtcatggagctgctgacccgcagggtcgaccgggtcgcggtcttccggccgctcgtccacgacggcccggaccgcatgtacgagttgttccgcgagcgctaccggctctcccagccgccggactcggtcttcgggatgcactacgcggcggcgaacgcgctccaggccgaacggggcctgaacgaactcgtctcgcggctcgtggaggactaccagcggctcgcggcggagtacgacgcggtcctggtgatcggcacggacttcgcccacacccagctccccgacgagctgggcctgaacgcgcggctcgccaacgagttcggcgccttcgtgctgcccgtcgtgggcggcaaggagcagtcggccgagtcggtgcgctcggaggcgcacaacgcgtaccacgcctacgcgggccggggctgcgacgtcctcgcgatgatcgtgaaccgggtcgcgcccgccgaccgcgacctcgtgcaggagcgcctgaccgggcggatcggcgtgccggtgtacgtcctgccggacgagccgagcctgtcggcgccgaccgtcgcgcagatcacgcacaccctcggcggaacggttctcctcggcgacgaggccgggctgtcgcgggacgcgctcgacttcgtcttcggcggcgcgacgctgccgaacttcctgcacgcgctcacccccggctgcctggtcgtgaccccgggcgaccgctccgacctcgtcgtgggcgcgctggccgcgcactcggcctccgcaccggccatcgcgggcgtcctgctgaccctcggcgagcgccccgaccaggggatactgaacctcgccgcccagctcgcgccgggcaccccgctcgtctccgtaccgggcaacagcttcccgaccgcgacggagctgttcaccctggaaggccgtctcggcgcggcgaccccgcgcaagacggagaccgcgctcggcctcttcgaacgctgggtcaacggtccggcgctcctggaccgcatccaggtcgcgggcagcggccgggtcacgccgatgatgttcgcgcacaagctcatcgagcaggcccgcgcgcggcgccgtcgcgtcgtgctccccgaggccaccgaggagcgcgtgctgcgcgcggcggacgtgctgctgcgccgctcggtgtgcgcgctgacgctgctcggcgaccccgccgtcatccgcaagaaggccgcggacctcggggtggacctcgaaggcgccgaactgctcgacccgcgcgactccgagctgcgcgggcgcttcgcgcgcgagtacgcggggctgcgggcgcacaagggcgtgacggaggagctggcgcacgacgtggtcgccgacgtgaactacttcgggacgctcatggtgcgcgccgggctcgcggacggcatggtctcgggcgcggtgcactcgacggccgcgacgatccgcccggccttcgaggtcatcaagacccgcccggacgcgaagctcgtctcctcggcgttcttcatgtgcctggccgacaaggtcctcgtctacgcggactgcgccgtcaaccccgacccggacgccgagcagctcgcggacatcgcgatccagtccgcgacgacggcggcggccttcggcgtcgagccccggatcgcgatgctctcgtactcgacggggacctccggctcgggcgcggacgtggacaaggtgcggcaggccacggagctggtgcgggccgagcgcccggatctgctcatcgagggccccatccagtacgacgcggccgtcgagccctccgtcgccgcgacgaagctgccggactcgccggtggcggggcgcgcgacggtgctggtcttccccgacctcaacacgggcaacaacacgtacaaggccgtgcagcgctcggcgaacgccgtcgcgatcgggccggtcctccagggcctgcgcaagcccgtcaacgacctctcgcgcggcgccctcgtcgaggacatcgtgaacaccgtcgccatcacggcgatccaggcggggcagagcgggaacgcggaggcgaccgcgtag

SEQ ID NO: 1668 - DNA, 2052 bp, Streptosporangium roseum DSM 43021
atgcgcatgcggagcatctacgtggccggtctcgggcgtggtgacggcaggcagatcgtcgagctcggcctgatggagctgctcacccgtcacgtggatcgggtcggggtgttccggccgatcacgggggagggtgacgaccgcacgctcgaactgctcaacgccagataccgcccggcggcctcggcgatcggggtcacggccgaggacgccgcggagatctacgcgcagcggggcaacgaggagctcatcgcccggctggtcgcccgcttccacacgctggagcgggagtgcgacgcgctgctggtgctgggcagctccttcgacaccgacgacctcccgcgcgagctggccctcaacgcccgcctcgccgccgagttcggcgcgccggtcatcgtggtggtgggggcgcacggcgagcaggcggccgagatcgcgatggagatgcgcaccggctaccaggtcttctcggacctgggcagcacggtgctggcggtgatcgccaatcgggtgccgcgggggatggtcgtcgagcccgagctgccggtgccctgctacgtcattcccgagcatccatcggtgtcggcgccgaccgtcggccaggtgctgcaggccgtggacgccaagcagatccagggggacgaggacgggctgcgcagggacgtgctcggattcgtgttcggcggggccacgctcccggtgttcctggagcacctggtcgacggagccctggtgatcacgccgggcgaccgggcggacctgctgctggtctcggtggcggccgagacggcgggtacggcgaggccgtccggcgtggtcctgacggtggggcaggagcccacggaggccgtcagggccctcaccgcccgcctggcccccggcatgccggtgctgtcggccacggcggacagcttcaccgtggccaccaccctgggcgggctggaggggcggctcaccgccgacaacccgcgcaagatcgagacggccatcggccacttcgagagccacgtggacaccgccgacctggccgaccggatcgagctggcccgctccgaccgggtcaccccgatgatgttcgagcacaccctgctggagcgggcgcgggccgaccggcggcacatcgtgctgccggagggcgaggaggaccggatcctccgggccgccgacatcctcctgcggcgcggcatcgtggacctcaccctgctggggcgggaggaggtgatccggcggcggatcggcgacctcgggctcgacctggccggggtgaccgtcgtcgacccgctgacctcgccgctgcgcgactcctacgccgaggagtacgccgcgctccgggcgcacaaggggatgacccttgagcgggccatggacgtggtcaccgacgtcaacttcttcggcacgatgatgttgcaccgaggcgtcgtggacggcgtggtctccggcgccgcgcacaccaccgccgccacgatcctgcccgcgttccagatcatcaagacggtcccgggcacctcgatcgtctcctcggtgttcttcatgtgcctggccgaccgggtgctcgtctacggcgactgcgcgatcaaccccgatccggacgccgagcagctcgccgacatcgccatctcctcggcccgtacggcggagcggttcggcatcgaaccgcggatcgcgatgctgtcgtactccaccggccactccggcagcggcgtcgacgtggacaaggtccgcgccgccaccgccctggtcatggagcgggcgccggacctgctggtcgaggggcccatccagtacgacgcggcggtggacgccagggtcgccgacgccaagctgcccggctcccgggtcgcgggccgggcgaccgtgctgatcttccccgacctgaacaccggcaacaacacctacaaagccgtgcagcgttccgccggggccgtcgcggtcgggccggttctgcaggggctccgcggaccggtcaacgacctgtcgcgaggcgcgctggtcaccgacatcgtgagcaccgtcgccatcaccgccgtccaggcgcaggaggccgcccgatga

SEQ ID NO: 1669 - DNA, 2076 bp, Salinispora tropica CNB-440
gtggatctcgtggcgcggagtgtgtatctgaccagcgtgagttccggcggcggcaagtccaccgtcgccctgggactggcggagctgttgtcccggcaggttggccgaatcggcatcttccgaccgttggtccgcggcgaccagccggacccgatcctcgccctactcagcgaacgctaccgggtcgaactgccgatcgaggacctcaccggcaccacctacaccgaggccaccgggatggtcgccgaaggccggcgggaacagctcgtctcccgcatcgtcgagcggtaccgcgcggtcgaacggcgcttccccgcggtggtcgtggtgggcagcgacttcgccgatggcggcgatggcgcaggcccgcgggaactggccttcaatgcccgcctcgcgaccgagttcggcagcgtcgtggtccccgtggtggacggatacgagcaggagaccgccaccatcgcggcggcggcccggggggcgtaccacgacctggcggacctcggcgcgacggtgctggcgatagtcgcgaaccgggtgaccggtccactcaccctgcccgagctgccggtacccgggtacctgatccccgaggtgcccagtgtgtcggcaccgaccgtggccgaggtggcgacggcgctcggcgccacccagctcggtggggacgacaccgcgctcagccgcgacgtactcgactatgtcgtcggcgcggcccacgtgcccacgctgctcgaccacctgaccgaaggcgctctggtgatcatgccgggggaccgggacgatctcctggtcgccaccaacgccgcgcacgtcgcggggcaggtcgcgctctccgggttggtcctcaccctcggcgaagcgccggacccgcgcacgatgcggctggtcgaacggctacggccgggcctcgccgtgctctccgtacccagcgacagctacgacacggtagccgcctgcaaccgaatcgagggccgactcagcgccagcaacccgcgcaaggtggaggccgcgctgggcgccttcgagcgctgtgtagacaccgacgacctgtcccgccgactccgggtcacccgttcggagcgggtcaccccgctgatgttcgagtacgacctgatcgaccgtgcccggacacagcgccggcatgtggtgctgcccgagggaagcgaggagcggatcctgcgggcagccgagatcctgctacgccggggtgtggtcgagttgaccctgctcggccgacccgacgatgtcgcccggcggacccgggagctgggcgtcgacatcgccgacgcacgggtgatcgatccattcaccagcgagtggcgtgacgagttcgccgacgggtacgcgaggctccgcggccaccggggcgttacccgggacctcgcccacgacatcgtgccccagccgaactacttcggcacgatgatggtctgggccgggtacgccgatggcatggtctccggcgccacccacaccaccgccgccaccatccgccccgccttcgagatcatccgcaatctacccgacgtctccatcgcctccagcgtcttcttcatgctgctcgccgaccgggtactcgtctacggcgactgcgcggtcaatcccgacccggacgccgcccaactcgccgacatcgcgatctcgtccgccgacaccgccgtccggttcggcatcgagccgcgggtggcgatgctgtcgtactcgaccggcagctccgggaccggtgccgacgtggagaaggtcgcggaggccactcgacgggttcgggagcgccgaccggatctgctggtcgaggggccgatccagtacgacgccgcgatcgacccggcggtggcggcgaccaagctgcccggcagcacggtcgccggccgggcgacggtcttcgtcttcccggacctgaacacgggcaacaacacgtacaaggcggtgcagcgctccgcccgagcggtggcggtcgggccggttatgcaggggctacgccggccggtgaacgacctttcccggggtgcgaccgtcccggacatcgtcaacacggtggcgatcaccgcgatccaggccggagaggcgggcacatga

SEQ ID NO: 1670 - DNA, 2070 bp, Salinispora arenicola CNS-205
gtggcagggagcgtgtatctaaccagcgtgggttccggcggcggcaagtccaccgtcgccctcgggctggcggagttgttgtcccggcaggtcggccgcatcggcatcttccggccgctggtccgtggcaactcaccggatccgatcctcgccctgctcagcgagcgctaccgggtcgaactgccgatcgaggacctctccggcaccacctacaccgaggccaccgagatggtcgccgaggggcaacgggaacagctcatctcccgcatcgtcgaacggtaccgcgcggtggagcgccgctacccggctgtggtcgtggtcggcagcgacttcgccgacggcagcgacaggggtgcgggtccccgcgaactagccttcaatgcccgactggcgaccgagttcggcagcgtcgttgtccccgtcgtcgacgggtacgagcaggagcccgccaccgtcacggcggcgacccgcggtgcataccatgacctggcggatctcggcgcgacggtgctggcggtcgtcgcgaaccgggtaaccggcccgctgaccctgccggacctaccggtgccgacgtatctgatcccggaggtacccagcgtctcggcgccgacggtggctgaggtggcggcggcgctcggtgccacccaactcgcgggggacgacgccgcactcggtcgcgacgtactcgacttcgtcgtcggtgcggcccacgtgccgacgctgctcgaccatctgaccgagggagccctggtgatcatgcccggcgaccgggacgatctcctggtcgccaccggcgccgcccatgtcgcgggtcacgtcgcgctgtccgggctggtcctcacgctcggcgtacaaccggacccacgcacgatgcggctggtcgagcggctgcggccggggctcgccgtgctctccgtgaccagcgacagctacgacacggtggccgcctccaaccggatcgagggccggcccagcgccagcaacccccgcaaggtggaggccgcgctgggcgcgttcgaacgctgcgtggacaccgacgacctctcccgccggctccgggtgacccgatcggagcgggtcacccccctcatgttcgagtacgacctgatcgaccgtgcccggacgcagcgccggcatgtggtgttgcccgaagggaacgaggagcggattctgcgggcagccgagatcctgctgcgccgggacgtggccgagctgaccctgctcggccggcccgacgatgtctcccgacggacgcgggagttgggcctcgacatcaccggcgcacacgtgatcgatccgttcaccagcgaatggcgtgacgagttcgccgacgagtacgcaaggttgcgtgcccaccgcggcgtcacagtggacctcgcccacgacatcgtgccccaacccaactacttcggcacgatgatggtgcgggccgggtacgcggacggcatggtctccggtgccacccacaccaccgccgccaccatccgtcccgcctttgagatcatccggaacctgcccgacgtctccatcgcctccagcgtcttcttcatgctgctcgccgaccgggtgctcgtgtacggcgactgcgcggtcaaccctgatccggacgcggcccagctcgccgacatcgcgatctcgtccgctgacaccgccgtccggttcggcatcgagccgcgagtggcgatgctgtcgtactcgaccggtagctccggcgccggtgccgacgtggagaaggtcgcggaggccacccgaagggttcgggaacgtcgaccagacctgttgatcgaggggccgatccagtatgacgcggccatcgacccgaccgtggcagcgacgaaactccccggcagcacggtcgccggccgggccacggtgttcgtgttcccggacctgaacacgggcaacaacacgtacaaggcggtgcagcggtcggcgcgggcggtggcggtcgggccggtcatgcaggggctgcgccggccggtgaacgacctctcccggggcgcgaccgtcccggacatcgtcaacacggtggcgatcaccgcgatccaggccgaggaggccggtgaatga

SEQ ID NO: 1671 - DNA, 2067 bp, Micromonospora sp. ATCC 39149
gtggcccggagcgtgtatctgaccagcgtcggttccggcgggggcaagtcgacgatcgcactcggcctcgccgagctgctctcccggcaggtcgagcggatcggcgcgttccggccgctggtccccgcgaccggcaccgaccccatcctcgccctgctcaccgagcggtaccggatggacctgccgacggccgacctgtccggcaccacgtacgcacaggcgagcgcgctggtcgccgacggccggcgggaggaactgatctcccggatcgtcgagcggtaccgggacgtcgaacggcgctgcccggcggtggtcgtggtgggcagcgacttcgccgacggcggggacgggacgggcccccgcgagctggcgttcaacgcccggctggccatcgagttcggcagcgtggtggtgcccgtggtcgacggcatcgggcaggggccggaggcgatcgcggcggcgacgcgcggggcgtaccacgatctggtggacctgggcgcgacggtgctggcggtgatcgccaaccgggtgccggggccgatgacgctgcccgacctgcccgtccccgcgtacgcgatcccggaggtgccgaccgtgtcggcgccgacggtggccgaggtggcggcggcgctcggcgcgaccctgctctccggcgacgacgccgcgctcggccgggacgtgctcgacttcgtcgtcggcgcggcgcacgtgccgaccctgctggaccacctgaccgagggcgcgctggtgatcaccccgggcgaccgggcggacctgctggtggcggcgagcgccgcgcacgtggccggccaggtctccgtcgccgggctggtgctcaccctcggcgagcagcccgacccgagggcgatgcgtctggttgaggggctcaacaccgggctcgcggtgctctcggtgcccagcgacagctacgacacggtggccgcgtccagccggatcgagggccggcccagcgtggcccacccgcgcaaggtcgaggccgcgctcggcgcgttcgagagctgcgtcgacaccgtcgacctggcccgtcggctgcgggtcagccgctccgagcgggtcaccccactgatgttcgagtacgacctgatcgaccgggcccgggccacccgccgccgcctggtgctgcccgagggggccgaggagcggatcctgcgcgccacggagatcctgctgcgccggggcgtggccgaactgaccctgctcggccgccccgacgacatcgcccggcgcacccgggaactgggcatcgacatcgccggcgcgtctgtcgtcgacccggcgggcagcccgtggcgcgacgagttcgccgaggcgtacgcgaagctgcgcgcccaccggggcatgaccgccgagctggcccacgacatcgtggcccagccgaactacttcggcacgatgatggtgcacaccgggcacgccgacgggatggtttccggggccacccacaccaccgccgccaccatccgccccgccttcgagatcatccgcacggtgccgggggtctcggtggcctccagcgtcttcttcatgttgctcgccgaccgggtgctcgtctacggcgactgcgccgtcaaccccgacccggacgccgcccaactcgccgacatcgccatctcctcggccgacaccgccgcccggttcggcatcgagccccgggtggcgatgttgtcgtactcgaccggggactcgggaaccggggccgatgtggagaaggtcgccgccgccacccggctggtccgcgagcggcggccggagctgctggtcgagggcccgatccagtacgacgcggcgatcgacccgagggtcgcggtcaccaagctgcccgacagcgcggtcgccgggcgggcgacggtgttcatcttcccggacctgaacacgggcaacaacacctacaaggcggtgcagcgctcggccggggcggtggccgtgggtccggtgatgcagggcctacgccgcccggtcaacgacctgtcccggggcgcgaccgtcccggacatcgtcagcaccgtcgccatcaccgccgtccaggccgccggggagtcgtcatga

SEQ ID NO: 1672 - DNA, 2112 bp, Arthrobacter sp. FB24
atggccaaggggatttacgtcagcgcgaccacaccgggatccggtaagtcgctcatagcgctggggcttgcggacacgctgcaccggcatgcggaccgtatcggctttttcaagcccgtggtccacggccccgacgccgcgtcggaccccatggtggcgctgatgaagtcccgcttcgatctcgacgacgaccgctgccgcggcggcctgacgtatgccgaggtccgcgccctgctggccgagggaaaccgggcggagatcgacgcccgctgcgtggagatcttcgccgaaatgtcacggcactgcgacgtggtgatcgtggagggcaccgacctcaccggccaggacgccgccgtcgaattcgacctcaatgcacgcctcgcgaacaacctggccgcctccatcgtggcggtggtcggcgcgaaggggcggacggtcgaggaggcggctgacgccgtcgaggtggcccgcaaggaactggcagcggaacgctgcagcctgctggccatcatggtgaaccgcgcggacccggaggacgtggacgggatcgtggccgccgtgaagcccggcgcctccggccggcccgtttatgtgttcccggagctggaggacattgcccggcccaccaccggcgaggtggccacggccctgggggtcggccaggtggccggccggcaggacatggaacgcgacgtccactccatcaaggtggcggccatgagcgtggccaacttcctgcacgtgctcgacgacggcgcgctggtgatcgtgccgggtgaccgtgcggacgtgatggtcgcgtgcctggcgtcgtcattctcgccggagttcccggtgccgtcagcactgatcctcaccggcggcctggccccggaaccgaacatctactcgatgctggcgcaggcgccgttccccgtgttcgccagcccggacgacacctacaccacggccaagcgggtgtccgaggtccgcagtgaaatctggtccgggcaccgacgcaaggtggcctcggccctggggctgtgggccaggcgggtggacgaggccgagctggtggaacgcctgcacctgccgcggctggagcggatgacgccgctgcggttcctgcacgacctgattgagcgggccaggctgcagcgccggcacatcgtgctgcccgagggaaacgacgtgcggatcctgcgggcggcggagatcctgcaccggcgggacgtctgcgacctcaccatcctgggcaacgagtcggacgtccgggagctggcgtccacacagggcattgacctctccggcatgaccatcgtggatcccgccacgtccgaactgcgccggcagtttgccgagaagtatgcggagctccgcgcgcacaagggcgtggacctggcccgggccctggaggtcatgctggacggcagctacttcggcaccatgatggtgcagctgggcgtggtggacggcatggtgtccggtgccgcgcacaccaccgcccacaccatccgtccggcgctggagttcgtgaagacccgcgacggcgtgaagatcgtctcctcggtgttcctgatgctgatgccggaccgggtgctggtgtatggcgactgcgcggtcaacccggaccccaacgcggagcagctggcagacatcgcgctggcctcggccgagacggccacgcagttcggcgtggagccgcgcgtggcgatgctgtcctactccaccggcgggtccggaacaggcgaggccgtggacaaagtccggcaggccaccgaactggtgaagggccgccgcccggacctcgccgtcgaaggccccatccagtacgacgccgccgtggacgcagcgatcgcgcagtccaagatgcccggatcgtccgtggccgggcaggccaccgtgttcatcttcccggacctcaacaccggcaacaacacctacaaggcggtgcagcagtcctcgggggcggtcgccgtcgggcccgtcctgcaagggctccgcaagccggtgaacgacctctcccgcggctgcacggtggaggacatcgtgaacacggtggccatcaccgcggtgcaggcgcagtccgtggcgccggtccaagagccggccgccgcggccgcgcacgcgtag

SEQ ID NO: 1673 - DNA, 2079 bp, Arthrobacter oxydans
atggccaaaggcatctacgtcagcgcaaccactcccggatcgggcaagtcactcgtggccctgggcctggcggacacccttcaccggcatgcggacaggatcggcttcttcaagcccgtggtccatggcccggacgccgcggccgatccgatggtcgcactgatgaaatcccgattcgcgctggaggacgagcgctgccgcggcggcctcacccacgaggaagtccggaccctgctggccgagggaaaccgggccgagatcgacgcccgctgcgtggaaatcttcgccgacatctcgcggcactgcgatgtggtgatcgtggagggaacggacctggtgggccaggactccgccgtcgaattcgacctcaacgcccgcctggccaacaacctggccgcccccatcgtggcggtggtgggagccaaggggcggaccgtcgccgaggccgcggccgccgtcgaggttgcccggaaggaacttgccgcggaacggtgctccctgctggccatcatggtgaaccgggcggacccggcggacctggatgcgatcgccgctgccgtgaagcccggcgcctccaagcggcccgtgtacatcctgcccgaactggaggccatcgcgcggcccaccaccggcgaggttgcagcggcgctgggcgtccgccagatcgccgggcggccggacatggaacgcgacgtcaaggacatcaaggtggccgccatgaacgtgggcaacttcctgaacgtgctggacgagggcgccctggtgatcgtccccggcgaccgagcggacgtgatggtggcgtgcctggctgcgtccttctcgccggagttcccggtggcctccgcgctcatcctcaccggcgggctcgcgccggacgccaacatctatccgctcctggcgcaggccccgttccctgtcttcgcggcgcgggaggacacctacaccaccgcccgccgggtttctgaggtccgcagcgagatctggtccgggcatcgccgcaaggtggcgtccgccctgggcctctggtcccgccgggtggacgaggccgaactggtggaacgcctgcacctgccccgggccgagcggatgacgccgctgcgcttccttcacgaccttatagagcgcgcccgctcgcagcgccggcacgtggtcctgccggagggaacggacgtgaggatcctgcgcgcggcggagatcctgcaccggcgcgacgtctgcgacctcaccgtgctcggccccgaatcggaggtccgcgaactggcggccgcccgcggcatcgacctgtccggcatcaacatcgttgacccggccacctcggacctgcgccagaagttcgcggagaagtatgcggaactgcgggcgcacaagggcgttgacctgcccaaggccctggagatcatgcaggacgtgagctacttcggcaccatgatggtccagctcggcgtggtggacggcatggtgtccggcgcggcccacaccaccgcccacaccatccggcccgccctggagttcgtgaagacgcgcgagggcgtgaagatcgtgtcctcggtgttcctgatgctgatgccggaccgggtgctggtgtacggcgactgcgccgtgaacccggaccccaacgtggagcagctggcggacattgcgctggcgtcggcggaaaccgcggcgcagttcggcgtggagccgcgggtggccatgctctcctactccaccggcggttccggctcgggtgaagcggtggacgcggtgcggcaggccaccgaactggtccgccagcgccgcccggacctcgccgtcgagggccccatccagtacgacgccgccgtggacgcctccatcgcggagtccaaaatgccgggctcctcggttgccgggcaggctacagtgttcatcttcccggacctcaacaccggcaacaacacctacaaggcggtgcagcagagctccggggccgtggccgtcgggcccgtcctgcaggggctgcggaagccggtcaacgacctctcccgcggctgcaccgtggaggacatcgtgaacaccgtggccatcaccgccatccaggcccaggccccagcctcctag

SEQ ID NO: 1674 - DNA, 2076 bp, Micrococcus luteus NCTC 2665
atgccccagggaatcttcgtctccaccacctcgaccggcgccggcaagtccctcgtcagcctcgggctggcggactccctctaccggcgctccggcacggtgggctacttccgccccgtggtccccggggaggacgtggaggccgaccccatggtcctgctcatgcgcgagcagttcggcctcaccgccgagcaggcccgcggcgggctcaccgccgccgaggcccgcaccctcatggccgagggccgcggcgacgaggtccagcagcgctgcgtggagcagtacgacgcgatgcgggccgcgtgcggcgtcgtcgtggtggagggcaccgacctgatcagcccggacccggccgccgacctcgacctcaacgcccagctggcccgcaacctcggcaccccggtggtcgccgtggtctccggcgccgagatgacgccggagcaggccgccgacgtcgtggacctggcccgccgcaccctcgacgacgccggcgtggagctgctggccgtcatggtcaaccgcgcggacccgcggcagctggacgccgtgggcgccgccgtgcgccccggccggcacgcctggcccgtctacgtcctccccgagctgcccgagctcgcccacccgtcggtggccgaggtggccgccgccctgcgcctggagcaggtggcgggccaggagacgctggaccgcgacgtcaccgaggtcaaggccgtctccatggagggcggcaacttcctcgaggtgctgcgggacggcgcgctcgtgatcgtctccggggaccgctcggacgcgatcctggccaccgtcgcctcctcgctgaccccggacttccccacgccctccggcatgatcctcaccaacgggatcctccccaaccgccagctgcagcggctctacctggacgccgccttccccgtgttcgccacgcacgacgacacgttcaccaccgccgccaaggtctcccgcgtgcgctccgagctctccagcgcgcagccgcgcaagaccgccgccgcgctcggcgcctggcaccagcgcgtggacggggacgagctgctgggccgcttcgacctgccgcgctccgacgtcgtcaccccgctgcgcttcctgcacgagctgatcacccgcgcccgcgcggaccgccgccagatcgtgctgcccgagggcgaggacgcccgcgtgctgcgcgccgccgagatcctgcagcgccgggacgtgtgcgacctcgtggtgctcgggcccgagtccgccgtgaaggagctggcctcccgcgagggcgtggacctggccgggatcgacctcgtggacccggccgactccccggacctggagcgctacgcgcaggagtacgcccgcctgcgcgcgcacaggggcgtggacctcgagcgcgcccgcgaggtcatgcaggagggcgcctacttcggcacgatgatggtccacctcggcgacgcggacggcatggtctccggcgccgcgcacaccaccgccaacaccatccgcccggccctggagttcgtgaagacccggcccggggcgtccatcgtgtcctcggtgttcttcatgctcctgcccgaccgggccctcgtctacggcgactgcgccgtgaacccggacccggacgcggagcagctcgcggacatcgccgtggcctccgccgccaccgccgcgcagttcggcgtggacccgcgcgtcgccatgctctcctactccacgggcgcctcgggctccggcgaggccgtggacaaggtccgcgccgccaccgagctggtccgcgagcgcgccccggagctgaaggtggagggcccgctgcagtacgacgccgcggtgaacgcctccgtggccgcctccaagatgccggactccgaggtggcggggcaggccaccgtgttcgtgttcccggacctgaacaccggcaacaacacgtacaaggcggtgcagcagtcctcgggcgccgtcgccgtcgggccggtcctgcaggggctgaacaagcccgtgaacgacctctcgcgcggcaccaccgtggaggacatcgtcaacaccgtggccatcaccgccatccaggcccaggaccagggctga

SEQ ID NO: 1675 - DNA, 2091 bp, Rothia mucilaginosa ATCC 25296
atgaccaccggtctttacctctccgctatgtcccagaactcgggcaagtccctcgcagccctgggcctagtagactccctcatcaagcgcgcagaccgcgtcggcttcttccgccccgtcttcgacggcgcaaccatcgccgacgaccccatggcacgcctcatccgtgagcacttcggcctgaccgaagagcaggtcggcggcgcagtctccatgaccgacgcactcgcactcatcgcagaaggcgacaccgaagaaatctccgcacgcgcagtctccgcctacgaaaaggtcgcagcaaacagcgacgtcgtaatcgtcgacggcgtctacctgcccgccaacgcgctctcagtcgaattcgacctgaacgtccagattgcccgtgacctcggcctgcccgtcatcgcaatcgtcggcgcacaagaagcaaccgtcgaagaagcagtcaccgcagtcgacgtggcacgcaccgaactgctcgcctccaaggcagacctgctcgcaatcatcgtcggccgtgcagaacccgaactgcgcgaagaaatcgagaactccgtcaagcgcggcgacgcaaacctgcccgtctacgtactgcccgaaatccccgagctgaacgcacccaccgtcggtgaagttgccgaagccctcaagctcgacaccgaaggcatcaaggcagaagacctcagccgcgatattcacggcatcaaggtcgcagcaatgaacgtctccaacttcctgaaccagttcgtcgacggcgacttcgttatcgtccccggcgaccgtgcagacatcgttgcagcaaccctcgcatccgcactggcaccgaccttcccggcaccctcgggcgtgctactcaccggcggtctggacgcactgcccggcaagaacaccgcagtcggctccctcatcgacaacgcaccgttccccgtgctgtccaccaccaaggacaccttcaagtccgcacgcgcagtctcccgcgtccgcggcgccctcgaaagcggccaccagcgcaagctcgcagcagcaatgggcggctgggacgagcacgtcaacaaggacgaactgctcgcacgcctcgaaattgagcgccccgcatccatgaccccgctgcgcttcctgcacaacctcatcgagaccgcacgcgcaaaccgccgctccgtggtcctgcccgagggttacgacgtgcgaatcctgcgtgcatccgaaatcattgctcgccgcgacttctgcgacctgatcctgctcggcaaccccgccaagatcgcagagatttgccaggccgaaggtatcgaactgcccagcaccgttcgtatcatcgacatcgaaaacaacgagtacaccgaggacttcgcagcaacctacgctgagctgcgtgcacacaagggcgtcaccattgaggctgctcgcgagcgcatgaccgacccctcgtacttcggcaccatgctggtttacaagggcatcgccgacggcatggtttccggtgcagtgaacaccaccgcgaacaccatccgcccctcgctcgagttcatcaagacccgccccggcaccaagatcgtctcctccgtcttcctgatgctgatggaagaccgcgttctggtctacggcgactgcgcagtgaacccgaaccccaacgcagagcagctcgccgacatcgcgaaggcatccgcggagactgcacgccagttcggcgtgacccccaaggttgctatgctgtcctactcgaccggcacctccggcgctggcgcagacgtggacgttgtgcgtgaggcaaccgagctcgtgcgcgcatcgaaccccgacttcgcggttgagggcccgatccagtacgacgctgcttcgaacatgtccattgcgtcgaccaagctgcccggcagcgaggtcgctggtcaggctaccgtgttcgtcttccccgacctgaacaccggtaacaacacctacaaggctgttcagcagtcttcgggtgctgccgctgtgggcccggttctgcagggtctgcgtaagcccgtgaacgacctgtcgcgcggtaccaccgttgaggacatcatcaacaccgttgcgatcaccgcaattcaggcacagagcctgtag

SEQ ID NO: 1676 - DNA, 2094 bp, Kocuria rhizophila DC2201
atgacgcagggcatctacatctccgcgatgacgccgctgagcggaaagacgctggtggcactggggctcacggacaccatgttcaagcgcacggacgccctgggcttcttccgcccggtcttcgacggcacctcccccgaggaggactcggtgctgcagctcatgaagcgcaccttcgacctcccggactcccggtgccggggcgcggtgtctctggagcgctgccgtgagatcctcgcctccggtgagcacgacgacctcgactccgccgccatggccgtgtactccgagatggcgctggagtgcgatgtgatcgtcgtggacggcaccgacctgctggcccacaacgcggtcaccgccgagttcgacctcaacgcccgcctggccaacaacatgggctgctccgtggccgcggtgatcggcgcccacgagtccgggcgcgtgaaagacgtgctcaacgcgatcgacgtgacccgcaccgagctgcgccaggccgggtgcgacatctacgccgtgatcgtcaaccgcgcggacccggagcaggcggagcagatccgccgggaggccaagcccggcaaccacaacctccccgcgtacgtgatcccggagatccccgcgatctccaaccccaccgtcgccgagctcgtggacgcccagggctacggcacggacttcaactccgcgtccctggaccgcgacatcaaggccgtgaaggtggccgcgatgaccgccgggaacttcctggaccagatggcggacggggacctggtgatcacccccggggaccggacggacgtggtctcggcaaccctggcgtcgtcgttggcgcccacgctgccggtgcccgccgggatgctgctgaccgggggcttccggcccgccggcgcggtgggctcgctgctgggcgcggcccccttccccgtgctgaccaccgagcgggacaccttcaccaccgcgcaggcggtggccggcacgcgcggcaccctggccggcgcgcactcccgcaagatcgccgccgcgcgcggtgcgtgggcggagcacgtggacagcgacgagctctcggggcggctcaccctgccgcggcccgtgcgacgcaccccgctgcggttcctgcacgagctcgtggagtccgcgcgggcggaccgcaagcggatcgtgctgcccgagggggacgacccccgcatcctgcgcgccgcggagctcatccaccgccgcaacttctgcgacctcaccgtgctgggcgatcccgaaacggtccgctcgctcgcgcagtccgagggcatcgagctcgacttcgacgccgacggcctggacctcgtggacttccagcacgacgacgccctgcgcgagaagtacgcggacgagtacgtgcggctgcgctcccacaagggtgtgagcaagggccaggcgctcgagcgcatgatggacggctcctacttcggcaccatgatggtccagatgggggacgtggacggcatggtctccggtgccgcccacaccaccgcgaacaccatccgcccggcgctcgagttcgtgaagacccgcgagggcgtgaacatcgtctcctcggtgttcttcatgctgctcgcggaccgcgtgctcgtctacggcgactgcgcagtgaaccccaacccggacgagcagcagctcgcggacatcgccctggcctccgcgcagaccgcccgtgagttcggcgtggacccccgcgtggccatgctctcctactccaccggcggctccggctccggcgaggacgtggagcgcgtgcgcgccgccaccgaccttgtgcgcgccgcggaccctgacttcgaggtggagggccccatccagtacgacgccgccgtggacgcctcgatcgcgaggtccaagctcccgggctcgcacgtggcggggcaggccaccgtgttcgtgttcccggacctgaacaccggcaacaacacctacaaggccgtgcagcagtccgcgggtgcggtggccgtgggccccgtgctgcaggggctgcgcaagcccgtgaacgacctctcgcgcggctgcaccgtggacgacatcgtcaacaccgtggccatcaccgcgatccaggcgcagacgctgtga

SEQ ID NO: 1677 - DNA, 2097 bp, Francisella tularensis subsp. holarctica FSC022
atgaaaaaatctatatttattctgcctacttcaaaacataccggtttacgtttattagcaagtagtatggtatatgcattacagcaaaagggattaaaggttggttcatttcatcctatctatgatatgcaaatgagcattaaaaatatacaggagtatttgcttaataatcgagttaaggattatgttgagattgttttagataagttctatcaaaaatcgcaagaatttgattttataataatctctggtctatttagacagggtaataatactcacaaactgtacccaataaatgctattattgatgagctaaatatagagatcgttaaagcgctaagctctgaagtaattataacttcatatcatggtaataagccactaattgatatcaataatgagttggattatgcaatgcgtagtttaccaaaacaaattaatattatcggtacgataatcacaaaattaaacgcgccatacgatgatgatggtagagtaagctttagtttaacagatgaggatatttcatcagagcaacagcagcaagtaactgtaaatatgcttagagaattaccagtctttgcacaaaaaggtctaaatctgataggtgttgtagagtggcagcaagaaaaaacttcaccaaggatattagatattaaaaatattcttaagttaaaccttatatcaagagtaagcctagaggcgcgtgttgatagagttatgatgtgctcaagaggcgttgataactttatcaatgatttaactccaaattctttagtaataacatctgctgataggtctgatattcttgtgacagtatgcttagctgcaaaaaatggtatgaaaattgctggaattttgttaacagcagaagaatatcttaatgataaggtgaaagagctttgtgttgaaacagccgaaaaagttggtctagcaattcttactactagaaataaaagtgtcaaaactattttacgaattgctgatattgatttgatgggtataccgcttgacgataaagagcgtatccagcgagtcaaagagattatttgtaattcattagatagagataaaataattagcgctattacagcggatgtgcttggacatcaggtgatgtcgccaccggcatttaggtatcatctactgaaaatggcgacaaaagctaaaaagagaattattttgcctgagagttatgagccaagaacccttcaagctgcaaaaaacagtcatgagcagggtttagctgaatgtgtgcttataggtgatagagataaaatccataaagtagcagaaatgaatggttttagccttcctaaggatatacaagttgtcaatatcgatgatgaggctaagataaaatatctaaataccttgatgaatcttagaaaacataaaggtttatctgaaagtatggctcgagatgctcttaaaaaccctatagtagtagcaacagttatgctttatcttggtgaggtcgatggtttagtttcaggtgctgagcatactacggcagatgtgcttagaccagcgttacagctaattaagactaagccaaactcttcgttggtatcatcagtattttttatgtgcatgcctgatcaagtgatagtatttggtgactgtgctgtaaatcaggatccctcggctgagcagcttgtcgatatagcgattcaaagtgctgaatccgcaaagaaatttggtattgagccgcgtgttgcgatgattagctatagtacaggaacatcaggctcaggtgtgcaggttgaaaaagtgtgtactgctacagaattgcttaaacaaaaagctccagagttattggttgatggaccgcttcagtatgatgctgcgatgattgaaagtgtcgctaagagtaaagctccagatagtccagttgcaggtagagcaaccgtattaatcttcccagatttaaatactggtaatacagtgtataaagcagtccaaagaagtgctaatgttttaagtataggaccagtattgcaaggtatcaataaacctgtaaatgacctttcaagaggggcaacagttgatgatataacttatacaattgctataacagctattcaagcaatataa

SEQ ID NO: 1678 - DNA, 2097 bp, Francisella philomiragia subsp. philomiragia ATCC 25017
atgaaaaaatcaatacttatccttccgacatcaaaacatactggtcttagaattttggcaagtagtgtggtatatgcgttacagcaaaaagggttaaaagttgactcatttcatcctatttacgatatagatatgagtatcgagcaaatagaatcatatttgcttaataatcgtgtaaaagactatgttgagatagttctaagtaaattttatgaaaaatgtctagattccgattttgctgtaatatctggattgtttagacaaggtaataactaccataggttatatccattaaatgcgattgttgatgaattgaatatagagattataaaagctcttggctcggaagtaataatagtctcataccatggtaataaacctataaatgatattaatgatgagcttgattacgctatgcgtagcttaccaaagcagattaatattatgggtgctgtaattacaaagttaaatgcgccttatgacgatgatgggagagttagttttagtttgactgaagaggatattacttatgataagcagcaacatgtgggtatagatgagcttaaagagttatcagtatttaaacataagggattggtacttttaggtgttgtagagtgggataaggaaagaacttcaccaaggatattagatatcaaaaatattcttaagctaaatcatatatcggaagttggtttagatgctcgtgttgatagagtaatgatgtgttcaagaggggttgataattttataagtgatttgactccaaattctttgattataactgctgctgatcgatctgatatcttagtgactacctgtttagctgcaaaaaatggtatgaaaatagcaggtattattttaacagctgaagaatatctagataataaggttagagagctatgtgtagaaactgctaagaaagcaggattggcaattctgacaacaaaaaataaaagtgtaaatacaattttaaaacttgcaagtattgatctaatgggaataccaattgatgataaagagcgtattcaaaaagtcaaagaagtaatatcttcatcattagacagagacacaatagttagatctattacgtcggatatctctgagcatcaagttatgtcgcctccagcatttagatatcatcttttgaagatggcgcgaaaagccaaaaagagaattattttaccagagagttatgagccaagaactttacaggcagctaaaaactgtcatgaacaaggcttagctgagtgtgtacttatcggtgatagagagaaaatctttaaagtggctgagatgaatggttttagtttacctgagagtatcgaagttgtaactgttgtcgatgaagctgaggcaaaatacctaaaaacattggtggagcttagaaaacataaaggtttgtctgaaagtatggctagagatgctctaaaagatccaatagttgtagcaacacttatgctttatttgggtgaagttgatggattagtgtctggtgctgagcatactactgcagatgttcttagaccagcattacaattagtcaaaactaagccaaattcatcactagtatcatcagtgttttttatgtgtatgcctgatgaggtgatagtattcggagattgcgctgttaatcaagatcctacagcagagcagttagttgatattgcgatacaaagtgctgaatcagctaagaagtttggcattgagcctcgtgttgcaatgattagttatagtacaggttcatcaggttctggggttcaagttgaaaaggtgcgtaaagcaacagagctgcttaaacaaagtgctcctgatttattggtagatggaccacttcagtatgatgctgctatgatcgagagtgtagcgaagaaaaaagccccaaatagtccagttgcaggtaaagctactgtactaatattccctgatttgaacacaggtaacactgtctataaagcagttcaacgaagtgcaaatgtattaagtattggtcctgtattacaaggtataaataagcctgttaatgatttatctagaggtgcaactgtagatgatataacttatacaattgcgataacagctattcaagcaatataa

SEQ ID NO: 1679 - DNA, 2136 bp, Baumannia cicadellinicola str. Hc (Homalodisca coagulata)
gtgtctcgtacgattatgttaatacctattgatgctagagtaggttttactagtgttagcctaggtctaatttacgctataaaacaaaaaaacatgcgctttagtgtttttcaaccaattgctcctcaatcctactatggaaaagataaccaagacgtaattactcgtatagtttgtaataaatatcatatcccatatactaaaccgctatgtataaattatgtggaatcattattagctgctaataaacaagatatcttaatggaagaaattattagtaattactattacaacaaaaaagaagcggcacttatattagtaataggactaaaacctacgcttcagtatcaatttatttatactttgaactatcaaatagctaaaatgttggacgctgaaattattttagtactctcactaagagaatatttaccagataaattacaacaactaatcaaattagcatttgtaaaattaggtggtaatcaaaatattactggtattattattaataaattgaatgccccaatattaacatattgtcatgctaatattgatatgaacgaactatttcataattcactgaatactagcattcatcatattgatatacaaagcttatctaaaaatagccctctaccagtaataggtgctattccttggaatattgatttaatcaatatcagagtaagtgatatagcttcatacctaaaggcaacgataattaatcaaggtaatattcaagctcgtagtataaaatcagttactttttgcacatgtaacctagctaatataattaagtatttccaaccagattccatgcttgtaacttcagttgatcgtaatgaggtgatagtagctatttgtttagctgtaatgaatggtgtagaaataggagcattactacttactagtagtagttatgaaatagatcaacatatctatcagatatgcaaaaaaactttccagactggtttacctgtatttgctatacagcagaatatattacaaactatgttaattttgcaacagtttcgaccagaaatacctatagataactctaggcaattagaaaacttgcaaaattatatggcaagttatattaatcatacttggattgaatctattacaacacaacgtactgaacgtggaatgcttttttcaccaccagcttttcgctatcatattacggaactagctcgtcaagcaaataaacgtatagtactaccagaaggtgatgaaccacgtaccattaaagcagcctctctttgcgcaaaaagaggcattgcacgttgtgtactactaggtaaccctagtaatattcagcagattgccatattaaatagtatcgaattaggacagggtattgaaattattgaaccaataatagcacgtgataaatatgtaaagcgcctagttcaattgcgttatcataaaggtatgactgaagatatagcttatcaacagcttaaagataatgtagtactaggtaccttaatgcttgagcaagacgaagtagatggtttagtatcaggagctatgcatactacagctaatactattcgtccaccactacaattaattaaaacagctccaggccatactttagtttcatcagtatttttcatgttactaccagaacaagtattagtatatggagattgcgctattaatatcaatccaacagctcaacaactagctgaaatagctattcagtctgctgactctgctgctactttaggtatagaacctaaagtagcaatgatttcatattctactggtgattctggtgtaggtaaagacgtagaaaaagtccgtcaagcaacctatttagcacaagaaaaacgtccagacctaataatagatggacccctgcaatatgatgcagctgtcatggcagaagtagccttatataaggcaccgaaatcccctgtagcaggtcaagctacggtatttatttttccagatcttaatactggtaatactacctacaaagcagtacaacgttcagctaagttaatttctattgggccaatactacaaggactacgtaaacctattaatgatctttcacgtggtgcacttgtagaagatattatctatactattgccttaactgctattcaatctaaataa

SEQ ID NO: 1680 - DNA, 2127 bp, Buchnera aphidicola str. APS (Acyrthosiphon pisum)
atgtcccgtattataatgttaatccctttagataaagatattggtttgacttcaatcggtttgagtatcatttattttttttatcaaaaaaaaataaaaaagaaatctgttcagtctatattgtatttttcctgcacacaaaattcatctaatagtacatcgcatgttattaataaatatttttcaaaaatcgttcatacagtagattacatagatttttctaaagttttgtttaattctccagagtattcatttttattaaataaagttatagatgaacattataataacaaatttttacgtgaacttattctaattgaaggtataaaaaataattattgtattaattctgaagaaatgaattatgatatttctcaaaatttgaatgcggaagtaatatttatagcaaatttagaaaattcttctcccgaatatattaaaaataaagaaaaaaaaattaatttttttttaaaacaaaaaaaatataaaaatattttaggtgttatttttaatcaaattaattctccttttctagaaaacaaatatgattttataaaaaagttgatagttttaaaaaaaataaaaaatgaaacaaaaacaatagtgcctaaaaaaatattaaaaaataattttttctcaattatagcctgtattccttggaatcgaaacatcgtaacaacacgtgtaatagatctttttaattttttaaatatacaacatactaatttagtacaaaaaaaaaatcatatcatagaagaaataatcatattcgatacgcatcatctaaatttattaaataaacactctttaaatactttagtaatagtttcttttagtcgtgtagatgtttttttaaatgttttaaattgtaatgtgaatcgtagtaaagtgaagtgtattatattaacgggaatattaaaattaaaaaaaaatattgcttctttatataaatttttaattaaaagatctatttctattttttttacagaaaaaaatacaatagagattttatctcaattgcaaaactttaactttgatatttctgtaaaagatataacatatattaaaaaattacagagatatatttccaattttttttgtcattcttcttttatgttttttaaaaaaaaatataatataaatgtaatatatcctccgaaagaattttgttataatttaaaattattatcacaaaaaaaaaataaacgtattaaattgcctgaatcatatgaaattcgaatattaaaatccgttgcaatatgcagtgattctaatattgctcaatgtgtgttattgggtgatccaaaaaaaatttatagtattgcaaacgataacgggattaatttaaaaaaaaatattgaaataattgatcctatttcagtaagacaagaatatcttgcacgttttttagaaatacggaaaggaaaaaatatcaacgaattttctgctaaaaaacaattagaagataatactgttttagcaactttgatactggaatctaatcatgtagatggattagtttctggatccataaataccacatctgatactatacgtccagcattgcaaattattaaaactaatcctcaaagtttattagtctcatctatttttttcatgttgttaccaaatcaagttttaatttatggtgattgtgcaattaatatcaatcctactgcagaagaattagcagtaattgccattcaatctgcagattcagcaaaaatgtttggaatagaaccacgtattgcaatgttgtcttattcaacgggttgttctggatttgggtgtcaagttgaaaaagtcaaagaagctacttctattattaagaatagaagatccgatttaataattgacgggcctatacaatatgatgcagcagtttcaaataaggttgctaaattaaaagcaccttcttcaccaatttcaggatctgcgaatgtttttatttttccagatttaaattctggtaatatagcttataaagcagttcaacgttcttcaagaatagtttctattggtccaatgcttcagggtttgagaaaaccagtaaatgatttgtcaagaggtgcctcagtggaagacattatttataccattgcattaacatcaattcaatctgaataa

SEQ ID NO: 1681 - DNA, 2112 bp, Verrucomicrobiae bacterium DG1235
atgaaacacgttttcttaactgtaccgacgggagccaaagtaggactctcgactgtatccatcggactcgtacgggccctcgaacgacagggcgtgcgcgtcgctttcttcaagccgatctcgcagccggcgaccactgaagagaccgaagaccgctcgaccgccttcatccgagccgtaactcccctcaccccgccagatcccattccgatggccgaggccaaaaagctcctcagcgaggacaaagtggagcttcttctcgaaaacattatcaacagattcgaagatgccgccaaaaacgcggacgtagtcatcgtcgaaggcctcatccagacagaacgtttccccatgggcgggcgacttaacaccaagctctctcaaaccctttcctcaaagcagatcctcgttaccaacctcggcaagcgtagcctcgactctctcaataaggagctggaactagccgtatccgattttaaaggacgaatcgctggcgtcgtcatcaacaagacagatatcgaagccgctcgcgaaagcatcgactttgacggcatcggcatcgagccgctcaaggagttcatcaccgtcaattgccccgtctttaagaacgaggaactcagcctcatcggaatggtgcccctcgacgagagactgctagctccacgcgtatcggacgtcgctcgactagtccaagctgaggttctcaacgaaggtgacatggcgaaccgacgcgtattccgcatcgaactcatcgcccgcaacgtgcctaacatgctgcacaccctgaagacaggcaacctgctggtcacgccatcggaccgtagcgacatcatcttggccgccagcatggcagccaacaacggagcccgcctcgcagggctcgtgctcaccagtgaccaaagacccgacgaacgtatcgtcaagctttgtcaaagtgcctggaaaagcggactcccagtcctacgcgtgggcaagacttccttcgagaccgcccgagcgctctacgacatgaatctcgaaatcgctccagatgacaacgaccgcatcaaccaggcgatggaaaccgtagcagtcaatgtaagcagcaactggatacggaacacgctttcatcggcgatgaagcgacagctttctccgccagcattccgacatatgctcactcgtaacgctcggcaaaaaacgaaaagaatcgtccttcctgagggcgacgagccgcgtactatgcaagcagcggtcagctgcaccgagcgaggaatcgcccgctgcgtcctgctcggcaatccctattcgatccaactcaaagcggatgcgatggggctgaccttgccgtcaaatctcgaaatcttaaatcccgacgtgattcgcgaacgctacgtttcctccctcgtggaaatgcgtcgccacaaaaacatgaccgagaaaatcgcgcgggaccacctcagcgacaacgttgttctcggcaccatgatgctcgcccatgatgaagtcgacggcctcgtgtcgggcgcggtccactcctcggcgaacacggtgcgccccgccatgcaactcatcaagacgcgtccgggcgccaaaatcgcctcctccatctttttcatgtgcctgccagatcaggtgctcgtctacggagactgcgccatcaatccagatccgaacgccgaagagctcgccgatattgctatccaaagcgccgagtccgccaaagccttcggcatagagcctatcgtcgccatgatcagctacagcacactgggatcaggctccggagtggacgtggacaaagtcgttgaagcgacacgactcgttaaagaagcgcgtcccgatatcgtgatcgatggtcccctccagtatgatgccgccgccatcgctgacgttgcccgaaccaaagctcccgacagcccggtagccggcaaagcaaacgtattcattttcccagacctcaacacaggcaacaccacctacaaagcggtgcaacggtcggccaacgtcatatcgatcgggccgatgctccaaggcctcagaaagccagtgaacgatctttcccgtggcgccctcaccgacgacatcatctacacgatcgccctcacggccgtacaagcgcagcaaaacgactaa

SEQ ID NO: 1682 - DNA, 2085 bp, Verrucomicrobium spinosum DSM 4136
atgccccacactctctaccttgcccccagcggcagcagcgccggcctcacgaccatcgccctcggcctggttcgctcccttgacattcacggcgtgaaggtggcgttctgcaaacccattggccagtccaccagccaggacaaggggccggagcgctccacacacttcgtgcgggaggcaactcacctgctgccatcgactcccattccgctggaccaggcagagaggttgatcacgaccggtcgaatggatgaactgctcgagcgggtgatcgaaaactatcacgcctctgcggcggatgcggatgtggtgatcgtcgaaggtctggtccacaccgccgagacgcctcaggccgatgaactcaatcttcaactggtcaagaccttgagcgctgaagtcatcctggtgggctccctcggatacgtaccgttggatgagttcgaatcgcgcatggagtacacctccaggaagtttggcgactccgtcgtgggctgcatcatcaatcgcgttccagacgccgttgaccagtcgctcaaggaactggggatgagcttcgccttgcgcagccgcttgttccatagcagcggattccacctcatcggcgcggtgccggagaaggcagaacttgcctcttgtcgggccgtggatatggcccgctatctgaacgccaccgttctgcatgagggggaattgaaaacgcggcgggtgcgccgtttcaccatgctggcgcggacggtgcccaacatgctggacacctttttgccgggctccgtgctgatcacgccttcggaccgcagtgacgtcatcgtcgccacctgcatggccacgctcaacgacattcccatcgccgccctgctgctgaccggtgacatggaggtgcctccggccatctttgacctctgccgggccgggcttgccaccggtctgcccattctccaggtgcccacgaacagctggcacactgccaccgcactcacccgcatgagcgctgaggtaccagtggatgacatcgagagggtgcagcagagcatggactacgtggcgagctacattgacagtgaatggatcgcctctcatgccgccattccggtggaggctcgcatgtcgccggccgcattctgtttccgtctcacggagcgagcccgccagacatcccgccgcatcatccttccagaaggcaatgagccccgcaccatccgcgcagcggtcatctgcgcccagcgtggcattgcccgctgtgtcctcattggttcccccgaggagatccgccgtgtcgcccggggccaggaggtcgaacttcccccacaggtggagatcctcgatcccgtgccgctgcggcaaaactacatcgctcccctggtggagatgcgcaaagcaaaagggttgactcctgaagctgccgcggagctgctggaggacaacgtgtggctgggcacagtcatgcttgccctgggccaggtggacggtcttgtgtctggagcagttcattccacggccaacaccatccgcccggcgctccagatcatcaagacccgccctggagcaaaggtcgtttcctcgatcttcttcatgtgtcttcccgatcaggtgctggtctatggcgactgcgcggttaacccggacccggatgcggagactctggcggacatcgccattcagagcgccgattccgcggcgaccttcggccttccggttcgcgtggccatgatcagctactccacgggagagtccggcagcggagtggacgttgaaaaggtccgcgaggccacgcagatcgcgcggagcaagcgccctgacttgatgctggacggcccgctccagtatgacgctgccgccgtggctgaagtggcggcctcgaaggcaccagacagcccggtcgctggcaaggcgaccgtcttcatcttcccggacctcaacacggggaacaccacctacaaggccgtgcagcgcagtgccagtgtcgtgagcatcggccccatgctgcaagggatgcgccggccggtcaacgacctctcccggggagccctggtggaggacatcgtgtacaccattgccctcacctccatccaggcaggtcagatctga

SEQ ID NO: 1683 - DNA, 2136 bp, Mariprofundus ferrooxydans PV-1
atgagccacgcatttctgcttgtttccaccggcgcgggagccggcctgactaccgtgagtctggggcttgtgcgggcgctggaccgattgggcatccataccggtttttgcaaaccgatcgcccagcttcacgatggtgatcatgggccggagcgctccacgcaactgattgaacatgtgatgaatatcagcccgccccacccgatcagtctcaggcgggcgactgccctgcttggaaccgatcaggaggggttattgatggaggaggtgattgcactctaccggcagagcacccggcacgctgatgtggtgatcgttgaggggctggtggcggatggtcatgccggttatgccactcgcctgaatgccgacgtggcgcgtgcgctggatgcagaggtgattctggtcggcaagccggaacccgatctggacgagtatattgatattgcggccagtgcctttggcgatagcaatggcacggcattgatcggtattatcctgaataaggtggggatgaccgatgcagggcatgctgtactgcaggcggataaactacagacagctgatgcagatgccgatcgtgagggagggcgcttatccgcggagcaccccgacatgatcgggaagcccttccattttatcggcgctatcccgtggcaggctacgttgatttcccctcggatgagcgatgtggccgattacatgtctgccaaaattctttattccggtgaaattgcccagaggcgggtggagcgtatggaggtctgcgcccgtacggtggccaacacgctcagtgtttatcagccccatacgctgctgatctttccgggtgatcgcgatgatgtgtttattgccgcatgtatgtccgccatgaacggcgtgccgcttgccggtatcctgctaaccggggggctgcagccgcatccgcgcgtgctggctctgtgtgcgcagtctattgagaccggcattccgatactgctggtagaaaccagttcctatcagacggccgcgcaactggtgcaaatgcccgcagaagtagcggtcaatgactatcatctgattgaccgggcgatggaccatgtggcgaatcatctggatgcagactggctgaaagcgcgttgcgcgattgaacgtcagccgcgtctgtcaccggcagcattccgttatcaactgattcagcaggccagcgaggcaaaccggcggattgtcttgcccgaaggtgaggagccgcgcacggtcatggcggcttaccagtgccggaagcggcagatcgcgcaatgcatactgctcggtaatccggccaagattcatcaggtcgccagctcacagggcatcgtgctggatgaaggcattactattattgaccccgctacagtacgggagcgctatatcgatccgatggtggtcttgcgacaacacaaggggatgaaccgtcagatggccgaggatcaattgcaggcccgcattgtgctgggcacgatgatgctggcgatgggcgaagtggacgggcttgtcgccggcgctctgcattcgaccgccaatacagtgcgaccagcctttcagttgatcggtaccagcgcatcggccaagctggtctcttccatcttctttatgtgcctgcccgaccaggttgtggtctatggcgactgtgcgattaatccggacccggatgccgagcagctggctgatattgctattcagagtgccgattcggctcggcgcttcgggctggagccgagggtggcgatgatcagttacagtaccggtgaatcaggtgcgggacttgaggtagacaaggtgagagaggcaacccgcatcgtcagggagcgtcgtccggacctgctggtggacggtccattgcagtatgatgctgcggcgattgtttcggttggacaaagcaaggcaccggagagtcgtgtggcaggtaaggcgaatgtgttcatattccccgatctgaatacaggcaataccacatacaaagctgtgcagcgcaatgctcatgtcgttagcatcgggccgatgctgcaggggttgtgcaagccggtaaatgatctgtctcgcggcgcatcggttgaagatattgtctataccattgcgctgaccgcgattcaggccggggcagccgacacggcctga

SEQ ID NO: 1684 - DNA, 2133 bp, Bermanella marisrubri
atgcagcatacgtttttcattgcgccgacggaaatgaaaaccggactcacgtccattacattgggactcatgcgcgcactagatcaactgggcgtaaaagtcgccgcatgcaaacctatttctcgcgaacaatacgacaatactcaccgttcgatagaattaatcgccgccgccagtggcaagcaaccacccactcccattagcttgccagaagcacaaaaaatgatgagcgataaaaaacatgatcgcctcatggaagaagtggttgccatgcaccataagatcgccaaagacgtcgatgtggtgattgtcgagggtgtcgaacctgatagaaatgaaccctacgcgttgcgtctgaatgtagaaatggcaaaaacattggacgcagaagtcattctcgtggctgcacctaatgatcgtgatcaaaaagccttggcaagccatgtggatatggcgaagaacctttacggtggtgacaaaaaccaaaagctattgggtattatcctgaataaaattaatgcccctgcaaaccgcagtattccaattaaaacgcaggagggaccagaacctacgccactcagtttggacgaactcaaagcgtcctataaatctttggaaaccgatcattttaaattgcttggccttattccatgggattctgatttggttgcaccgcgaaccaaagatattgccaattacttacaagctgatgtcatcagtgcggccaatatggaggacgcccgtgttaaacgcatcagtctttgcgcacgtactgttcctaacatgattacagctttacaacctggcgccctcattgtgacaccaggtgaccgcgaagacatattgctagccgctgctatggctgcacaaaacggcatgcccttggcgggccttttatttaccagcgatcttgatccagacgaacgtgtcatggggctcatcgcgcccgctctagcccatatgccagtgctgaaagtaagcacagacaccttcacaacagcaacacagctagccagtatggacgatggtgttaaagccagcgacccacagcgtatgaacgcgatcatgacgcacatggcagagcacttggacagtgaatatctagcagcgcgtttagaagtagaccatcacgtgcgactcagtcctgcagccttccgttaccaacttgtgcagcttgccagccaagccaataagcgcatcgtattgccagagggtgatgagccccgaaccattcaggcagccgccatgtgccagcaacgaggtattgcacgctgtgttctgctaggtaacccagagcgaattcaacaagtggcagcaagtttaggtgtaacattaccggaagaccttgaaatactcgatccagaagccatccgtgagcgctatatcgatccaatggtcgagctacgtaaacacaaaaacctaacggctccaatggcagaggcacagctggaagacaatgtcgtattgggaacaatgatgcttgccctagacgaagtggatggtttagtcagtggtgccgtacacactacagcgaatactattcgtcctgcactgcagatagtaaaaaccgctccagacgctaagctggtgtcctcggtattttttatgctgttaccagaacaggtaatggtatatggcgactgtgcagtcaacccagaccccaatgcttctgagctagcggatatcgcactgcaaagcgcacaaagtgcagaagcctttggtatcgcccccaaagttgccatgatcagctacagcactggctcatccggcagtggcagcgatgtggaaaaagtacgtgaagccaccagcattgcacaaaaaaaccggcccgatctgctgatcgatgggccactgcaatatgatgcggccaccaccgcaagcgtagccgcatctaaagcacccgatagtaaggttgccggccaggcaagcgtcgttattttccctgacctaaatacaggtaatacgacctataaagcggtgcagcgcagtgcaaatgtcgtaagtattggcccaatgttgcaaggtttggcaaaaccggtaaatgatttgtcccgtggtgctttagtagaagatattatctacaccattgcactgacagctatccaagcggcgaatcaagccaaagcaaaataa

SEQ ID NO: 1685 - protein, 699 aa, Kineococcus radiotolerans SRS30216
MARVLLVVPTGHGAGLTSTCLGLVRALDARGVAVGFHKPLAQPTRATGPDRSVALVRLTTALDPSEPIPASRVVERLSRGDIDDLMEEVVAAAEGVLAAHDVVVVEGLAPSADQVFSGRVNQALATALDADVLLVGSAGVDGTDPGAPERIAEDMAVTAGTYRTGEALRVIGGVVSRWPVPEDPETAVARVARLRGALEHHGIPLVGAVPFRADLVWARVRDLVHDLDVEVLTHGDQGRRIKEVVVAAQAVPGMLPLLREGRLILVPGDRHDVVMATCLAALNGNRLAGLLLTAGVGMDPRVAELTAAAAATGLPILRSDRSTYATATAVNRLDPEVPADDAERALAVSTTVADALDPGWLAKLPTASHTPRLSPAAFRRRLTTLAAERVQRIVLPEGAEPRTVQAAAICAERGIARPVLLAHPDEVASVAAGLGLTLPEGVEVLDPAGLVERYVDVLVEARKHKGMQPDVARDSLADPIWLGTTMLQAGDVDGLVAGAVHTTAATVRPALQVVRTKPGARLVSSVFFMCLPDDVVIYGDCAVNPDPGAEDLADIALQSAASARAFGIEPRVAMISFSTGSSGSGSSVDKVAEATRIARERDPDLIIDGPLQYDAAAVASVAASKAPDSPVAGRATVFVFPDLNTGNTTYKAVQRNAGVISVGPMLQGLAKPVNDLSRGALVDDIVYTIALTAIQASRG

SEQ ID NO: 1686 - protein, 719 aa, Reinekea sp. MED297
MKYTYFISATGAGTGLTSVCLGLVRALEQLGVRVAFSKPIAQQFGPDAEPERSTHLVNATLGLNPAKPIKLSHAQQQLALGQTDRLMEDIISIAQSSGEGADILIVEGLVPVADENYIAELNRNMAKALDADVILVSAKNKDSSAQLNERIKMTASLFGGVNHKSVIGCILNKVGAPEPASQQVIAEEEPDEADRHRTAKSRSIDELEAVLPVFQGDSFKLIGAVAWNPLLVAPRTIDVAEHLGADIINAGQIKERRVQSITVCARTMPNMLHTLKAGTLVVTPGDRDDILMASSMAALNGVPLAGVILTGGIKPEDSVMQLCHSAFATGLPVLTSNLNTFSSAQYLNSMNTEVPADDISRMESVMEAVASSINAKWLAERAEVVGERRLSPPAFRHLVVKSARKAAKRIILPEGNEPRTITAAAICHEKGIAHCVLLGNPDEIHRVAQTQNIVLPPSIEIIDPEKARPKYIEPMVELRKHKGLTAPMAEAQLEDPIVLGTMMLARDEVDGLVSGAVNTTANTVRPALQLVKTRPDSSLVSSVFFMLLPDQAVVYGDCAINPDPNAEQLAEIAIQSGDSAKAFGIEPRIAMISYSTGQSGSGSDVEKVREATRIAKELRPDLLIDGPLQYDAASTPSVAASKAPDSKVAGRATVYVFPDLNTGNTTYKAVQRSANVVSIGPMLQGLRKPVNDLSRGALVEDIVYTIALTAIQADQMTNS

SEQ ID NO: 1687 - protein, 717 aa, Teredinibacter turnerae T7901
MHSFYLAPTSSGTGLTSVCLGLVRALDQLGVRVAFFKPIAQIYGTDTGPGRSNTLIQETVGLQPAPSISLSYAQHKVASGGLDDLMEEVISNFQASAGDADVMVVEGLVPRPNEDYIVRLNTRIAATLGSDVILVAAKKHYSSAQLNERINITASIFGGLNNPRLLGCILNKVGAPPKGSHRVRADDAADDWEVAEQNIEFVKRKLPIFNHQDFRCLGIIHWNPAFIAPRTLDVAKHLNARVLHAGNIVQRRVSSVVLCARTVANIVYALKPGTLIVTPGDRADIMLAASQASLNGVPLAGVLFTGDMVPDERVMTLCRSAINTGLPILSSELDSLATVQLLDNMSEEVPAEDVQRMLEVMDEVAHSLDTQWLADRASLPQDVRMSPPAFRHYLVRQAQSLSKRIVLPEGDEPRTLQAAIICHSRGIARCVLLGKPETIHSVAEVNGLQIPDGLEILDPENIRKSYVQPMVALREHKGLSQPQAEVQLEDSVVLGTMMLAVGEVDGLVSGAMHTTGNTIRPALQLIKARTESSIVSSIFFMLMPDQVLVYGDCAVNPNPTAEQLAEIAIQSAESAKAFGIDPKVAMISYSTGSSGKGSDVDKVRQATEIAQAKRPDMIIDGPLQYDAAAIASVAASKAPGSPVAGKATVFVFPDLNTGNTTYKAVQRSANVLSIGPVLQGLKKPVNDLSRGALVDDIVYTIALTAIQAEQAAKLNYY

SEQ ID NO: 1688 - protein, 717 aa, Marinobacter aquaeolei VT8
MAKSLFIAPTSLDSGLTSVCLGLLRALEREGVSVGFYKPFSQSVHRGEALHNDGKDSSVAFVRARSHLEPPDPIPLKKAQQLLNHGKADLLMENVVGEYQKVANEVDVVIIEGLVPDRTEAYIARLNVEVARNLGSEVILVSTPKSCTASELDDDLDFSSRLFAAPSDPDVIAVILNKVGEPQKSGMALDHPPASEATEIDYHTSCKVFANGRFQLLAQIPWQPQLLAPRVSDVARELGVPVLHEGQMHSRRVQRVSVCARSIRNMTDTLKPGTLMVTPGDREDIVVATAVAALNGVPLAGLMLTGGLMPDERVIELCRRALDTGLPVLSSETNTYESAHLLANLSSAIPIDDPERIEEAMESVARRINTQWLQEHLKVQRQRRLSPPAFRYQLSERARAAAKRIVLPEGSEPRTIQAAIICHQRNLAHCALIGEPHEIRSVAASQGVELPKDLEIIDPQSVRERYVAPMVELRKHKGLTPDMAEAMLEDNVVLGTMMVAMDEADGLVSGAIHTTANTVRPALQLIKTHDNAKVVSSVFFMLLPQQVLVYGDCAINPDPNAEELADIAIQSAESAEAFGIEPVVAMISYSTGESGSGEDVDKVREATRIARERRPDLLIDGPLQYDAAAIESVAKSKAPGSKVAGKATVFVFPDLNTGNTTYKAVQRSANVVSVGPMLQGLRKPVNDLSRGALVEDIVFTIALTAVQAKQVADAGAA

SEQ ID NO: 1689 - protein, 715 aa, Hahella chejuensis KCTC 2396
MAKVLFIAPASVSVGLTSVCLGLIRAYDSVGLRVAFFKPFAQPRDNHHETDRSIIFTREKMGLTVPDPMSLRHAHNLMSQQQTPLLMEQTIALFHKVDTEADVVIVEGVAPPPGDDYSARLNVEVARNLDAEVILVAAPDGMPPQDLDDHLSLASRLFADPSDPDVVGCVLNKVHAPHGDEPPFSDDADEDKTSAERHDYGKECKVFRQSHFRLIASIPWRADLVAPRTSDIVEELEAEYLNEGKSKQRRVLHTTVCARTIPNMVNRLKPGALIITPGDREDIFVTSCAAALTGVPLAGLLLTGGLKPDPRTLKLCQSALDTGLPVLSTRKDTYVTASMVSRMDTEVPLDDMERIESVIASVSAHIDPEWLKQSVSLPRKPRMSPAAFRYQLSKRAKEANKTIILPEGNEPRTIQAATICHDRGIAKCILVGKRQEILAVAEAQGVQLPDAIQIIEPDQVREKYISPMVELRRHKGLTPQMAEAQLEDNVVLATMMLALGEVDGLVSGAVHTTANTVRPALQLIKARKGCRIVSSVFFMCLPEQVLVYGDCAINPDPDAEELADIALQCADSAVLFGIEPRVAMLSYSTGDSGTGSDVDKVRAATKLAHEKRPDLLLDGPLQYDAAAIEDVAKTKAPDSKVAGKATVFVFPDLNTGNTTYKAVQRSANVISMGPMLQGLKKPVNDLSRGALVEDIVYTIALTAVQATQNTEVLES

SEQ ID NO: 1690 - protein, 697 aa, Pseudomonas mendocina ymp
MHTFFIAPTGFGVGLTSISLGLVGALERSGLKVGFFKPIAQPHAGDLGPERSSELIARTHGLHSPKPLPLSHVERMLGDGQLDELLEDIISLYQQAAADKDVVIVEGMVPTRHASYAARVNFHLAKSLDADVILVSAPEDESLTELSDRIEIQAQLFGGPKDPKVLGVILNKVRSEDGIEAFAERLQEFSPLLKTEDFRLLGCIPWQDELNAPRTKDIAELLGARILNAGDYEQRRMLKIVLCARAVANSVQLLKPGTLVVTPGDRDDIILSACLAAMNGVPLAGLLLCSDFAPDPRIMELCNGALASGLPVMTVSTGSYDTATNLNRLNKEIPVDDRERAEKVSDFVAGHIDHDWLTTRCGTPRELRLSPPAFRYQLVQRAKAAAKRIVLPEGSEPRTVQAAAICQARGIARCVLLAKPEDVHAVARAQGIELPEGLEILDPDLIRGRYVEPMVELRKGKGLNAPMAEAQLEDTVVLGTMMLALDEVDGLVSGAIHTTANTIRPALQLIKTAPGYNLVSSVFFMLLPDQVLVYGDCAVNPDPNAEQLAEIALQSANSAQAFGIEPRVAMLSYSTGDSGSGEEVEKVRAATRLAREKRPDLLLDGPLQYDAAAIESVGRQKAPNSPVAGRATVFVFPDLNTGNTTYKAVQRSADCISVGPMLQGLRKPVNDLSRGALVDDIVYTIALTAIQAANLPS

SEQ ID NO: 1691 - protein, 704 aa, Pseudomonas aeruginosa UCBPP-PA14
MHTFFIAPTGFGVGLTSISLGLLRALERAGLKVGFFKPIAQLHPGDLGPERSSELVARTHGLDTPKPLPLAQVERMLGDGQLDELLEEIISLYQRAAADKDVVIVEGMVPTRHASYAARVNFHLAKSLDAEVILVSAPENETLTELTDRIEIQAQLFGGPRDPKVLGVILNKVRGEADAANAEDGVADFARRLTEHSPLLRDDFRLIGCIPWQDELNAARTRDIADLLSARVINAGDYEQRRVQKIVLCARAVPNTVQLLKPGVLVVTPGDRDDIILAASLAAMNGVPLAGLLLCSDFPPDPRIMELCRGALQGGLPVLSVATGSYDTATNLNRMNKEIPVDDRERAERVTEFVAGHIDFEWLKQRCGTPRELRLSPPAFRYQVVQRAQKAGKRIVLPEGSEPRTVQAAAICQARGIARCVLLAKPDEVQAVAQAQGIVLPEGLEIIDPDLVRQRYVEPMVELRKGKGLNAPMAEQQLEDSVVLATMMLALDEVDGLVSGAIHTTASTIRPALQLIKTAPGYNLVSSVFFMLLPDQVLVYGDCAVNPDPSASDLAEIAVQSAASAQAFGIPARVAMISYSTGDSGSGVDVDKVREATRLAREQRPDLLIDGPLQYDAAAIASVGRQKAPNSPVAGQATVFIFPDLNTGNTTYKAVQRSADCVSVGPMLQGLRKPVNDLSRGALVEDIVYTIALTAIQADAQAPA

SEQ ID NO: 1692 - protein, 696 aa, Pseudomonas syringae pv. tomato str. DC3000
MQTFFIAPTDFGVGLTSISLGLVRTLERAGLKVGFFKPIAQPHPGDLGPERSTELMARTHGLKPPKPLGLAHVERMLGDGQLDELLEEIINLYQQAAVGKDVLVVEGMVPTRSASYAARVNLHLAKSLDAEVILVSAPENEVLTELSGRVELQAQLFGGPKDPKVLGVILNKVRTEESMEVFAARLKEHSPLLRNGDFRLLGCIPYRAELNAPRTRDVAELLGAQVLNAGDYDQRRMSRIIICARTVLNTVPLLKPGVLVVTPGDRDDIILAVSLAAINGVPLAGLLLTSDTVPDPRIMELCRGALQAGLPVLSVSTGSYDTANRLNQLNKEIPIDDRERAEIITDFVASHLDASWLHQRCGTPRELRLSPAVFRYQLIQRAQAANKRIVLPEGNEPLTIQAAAICQARGIARCVLLARPEEVQAVAQAHGIELPPGLEILDPDLIRERYVAPMVELRKSKSLNAPMAEQQLEDPVVIGTVMLALDEVDGLVSGVVHSTANTIRPALQLIKTAPGCTLVSSVFFMLFPEQVLMYSDCIMNPHPSASELSEIALQSADSATAFGISPRVAMISYSSGNSASGEEVEKVREATQLARETRRDLLIDGPLQYDAAANEHVARQLAPDSQVAGRANVFVFPDLNTGNTTYKAVQRSADCVSLGPMLQGLRKPVNDLPRGAQVDDIVYTIALTAIQADTLS

SEQ ID NO: 1693 - protein, 699 aa, Pseudomonas fluorescens Pf-5
MQTFFIAPTDFGVGLTSISLGLVRTLERAGLKVGFFKPIAQPHPGDTGPERSTELVARTHGLKPPQPLGLAHVERMLGDGQLDELLEEIITLYQQAAIGKDVLIVEGMVPTRSASYAARVNLHLAKSLDAEVILVSAPENEVLTELSGRVELQAQLFGGPRDPKVLGVILNKVRTDESMEAFSARLKEHSPLLRSGDFRLLGCIPFQPELNAPRTRDVADLMGAQVLNAGDYESRRMTKIIICARTMRNTVELLKPGVLVVTPGDRDDIILAVSLAAINGVPLAGLLLTSDTLPDPRIMELCRGALNAGLPVLSVSTGSYDTANQLNGLNKEIPIDDRERAEIITDFVASHLDANWLHQRCGTPREMRLSPAVFRYQLIQRAQEANKRIVLPEGSEPLTVQAAAICQARGIARCVLLAKPEDVHAVARAQGIELPEGLEILDPDLIRQRYVEPMVALRKSKSLNAPMAEQQLEDPVVIGTVMLALDEVDGLVSGVIHSTANTIRPALQLIKTAPGCSLVSSVFFMLFPEEVLVYGDCVMNPHPSASELAEIALQSADSAAAFGITPRVAMISYSSGDSASGEEVEKVREATLLAHEAQRSLLIDGPLQYDAAANENVARQLAPNSQVAGKATVFVFPDLNTGNTTHKAVQRSADCVSLGPMLQGLRKPVNDLPRGAQVDDIVYTIALTAIQAANRPMDV

SEQ ID NO: 1694 - protein, 696 aa, Pseudomonas entomophila L48
MQTFFIAPTDFGVGLTSISLGLVRTLERAGLKVGFFKPIAQPHPGDTGPERSSELVARTHGIKPPTPLSLAHVERMLGDGQLDELLEEIIRLYQQACVGKDVVVVEGMVPTRHASYAARVNLHLAKSLDAEVILVSAPENEVLSELSGRVELQAQLFGGPRDPKVLGVILNKVRTDESMADFATRLREHSPLLRGNDFRLLGCIPYQADLNAPRTRDVAELLGAQVLNAGDYEQRRMNKIIICARTVANTVPLLTSGTLVVTPGDRDDIILAVSLAAINGVPLAGLLLTSDSKPDPRILGLCRGALQAGLPILSVSTGSYDTANQLNSLNREIPVDDRERAEFITDFVASHLDADWLHQRCGTPRELRLSPAVFRYQLIQRAQQANKRIVLPEGAEPLLVQAAALCQARGIARCVLLAKPEAVEAVARAQGITLPPDLEVLDPELIRGRYVEPMVELRKSKNLNAPMAEQQLEDPVVIATMMLALGEVDGLVSGLVHSTANTIRPALQLIKTAPGSSLVSSVFFMLFPDQVLVYGDCVMNPHPSAAELAEIARQSAESAESFGIAPRVAMLSYSSDSAASDEEVEKVREATRLAQQAEHDLLIDGPLQYDAAANPEIARQLAPSSPVAGRATVFVFPDLNTGNTTHKAVQRSADCVSLGPMLQGLRKPVNDLPRGAQVDDIVHTIALTAIQASTVR

SEQ ID NO: 1695 - protein, 712 aa, Azotobacter vinelandii DJ
MHTLFLAPTGYAVGLNSISLGLIRALEQAGLKVGFFKPIAQPFPIDQGRERSCLLVERTLGRSTPEPILLDQVERHLASGETDLLLEEVVSRYQQAAAGKDVVIVEGMLPTRDSDYSAYLNPLLSKSLNAEVILIAVQGGDGLKQLAERIEIQAQLFGGIKSPKVLGAIINKIDSGDGIPAFVERLKEYLPSLGSTDFQLFGAIPFAEELNALRTRDVAELIGAQVLSAGEADRRRVSKIVLCARAVPSTVPLLQPGVLVVTPGDRDDVILAASLASLNGVKLAGLLLCSDFMPDPRIMELCKAALDGGLPVMSVTTGSYDTATNLFALNKETPADDIERATRVTDFIAGHLHPEYLRSRCSLPRELLLSPPAFRYQLVKSAQEADKRIVLPEGTEPRTIRAAAICQERGIARCVLLARPEEVRAVAREQGITLPDGLEILDPESIRAQYIAPMVKMRQSKGLTPEMADEQLRDTVVLGTMMLALDEVDGLVSGAVHTTANTIRPALQLIKTAPGYNLVSSVFFMLLPDQVLVYGDCAVNPNPSAAELAEIALQSAESAVALGVHPRVAMISYSTGDSGSGAEVDKVREATRIAQERAPGLPIDGPLQYDAASVASVGKQKAPNSPVAGQATVFVFPDLNTGNTTYKAVQRNANCISVGPMLQGLAKPVNDLSRGALVDDIVFTIALTALQAASIDKQEKQKALEQGQPVGA

SEQ ID NO: 1696 - protein, 698 aa, Pseudomonas stutzeri A1501
MHTLFLAPTGFGGGLNSISLGLIRALESAGLKVGFFKPIAQPFPVDQGRERSCILVERTLNLTSPEPLPLEQVERQLADGEIDLLLEDVVSRFQQVAVGKDVVIVEGMVPTRESNYTQRINTQLAKSLDAEVILIAAQGSDSLKRLAERIEIQAQLYGGAKDPKVLGVILNKVKTEEGLPAFVDSLKQHLPLLGSADFQLLGAIPFSEELNALRTRDIAELLGAQVLNAGEADQRRVNKIVLCARAVPNTVQLLRSGVLVVTPGDRDDIILAASLASLNGEKLAGLLLCSDFAPDPRILELCKAALDGGLPVMTVETNSYDTANNLFGLNKETPADDIERATRVTDFIAKHLHPEFLHTRCSVPRGELRMSPAAFRYQLVKRAQDANKRIVLPEGNEPRTIRAAAICQERGIARCVLLAKPEEVQQVAREQGITLPASLEILDPDSIANRYVEPMCEMRKAKGLTPDDAREQLKDTVVLGTMMLALDEVDGLVSGAVHTTANTIRPALQLIKTAPGYSLVSSVFFMLLPDQVLVYGDCAVNPNPSATELAEIALQSAESAVALGVNPRVAMISYSTGSSGSGAEVEKVAEATRIAQERAPDLPIDGPLQYDAASVLSVGRQKAPNSKVAGQATVFIFPDLNTGNTTYKAVQRNANCLSVGPMLQGLAKPVNDLSRGALVDDIVFTIALTALQAANQKG

SEQ ID NO: 1697 - protein, 695 aa, Nitrosomonas europaea ATCC 19718
MHTFFVTSTGFGVGLTSTSLGLVRALEYGGLKAGFYKPVAQQHPGNSKLEYSTELISRTLGLAPPAPLPLATVEHLLGEGQIDDLMEDIVRRFKQASEGYDVMVVEGMVPTRHVSYASRVNTRLASSLDADIILVSSAEDDALQAITDRIEIQAQFFGGAQNPRLLGVILNKIRTDHSDDLFEQLKNHSTLFHQSSFQILGCIPWEDSLNAPRMADVVTQLQAQIVNAGDSEKRRVQDIVLFASAAPNSVTLLRPGVLVVTPGDRDDIVMAASLAVLNGVPLAGLLLCSDFPPDPRVLELCKGALTKGLPVCTVTTNSYDTAANLHRMNREIPLDDHERAERITNFVANHIRQELLVKRCGEPQEQRLSPPAFRYRLVKRAQEADCRIVLPEGYEPRTIQAATICQERGIARCVLLAKPDAVKAVASARGITLPEGLEMIDPEKVRRNYVAAMVELRKHKGLNEPMALAQLEDNVVLGTMMLATGEVDGLVSGAINTTANTIRPALQLIKTAPGFKLVSSVFFMLLPEQVVVYGDCAVNPNPTAEELADIALQSAASAQALGIEPRVAMLSYSTGDSGSGQEVEKVREATRLARLARPDLLIDGPLQYDAAAIASVGRQKAPGSPVAGRATVFIFPDLNTGNTTYKAVQRSANVVSVGPMLQGLRKPVNDLSRGASVEDIVYTIALTAVQAASQR

SEQ ID NO: 1698 - protein, 691 aa, Azotobacter vinelandii DJ
MQTFLIAPSSYGVGLTSISLGLVRALERYGLKVGFFKPVAQPHPGDCGPERTSALIARTHHLDPPEPLPLARVERRLGDGQLNELLEDIVGRLQQLENGHDVLIVEGLVPSPQVGYAARLNGHLARSLNADVILVSTPAEESLEELRDHLEIQARLLGAGQDTPVAGAILNKVPPGPLAERLCQPEPLGRNLRLLGCVPWRDTLNTPRTSDIADLLGARLLNPGDYRQRRVQHSLLCAAAAPSLLPRFKPGTLLLAPGDRHDVILAAGLASRNGMSLAGLLLCGALPADERVLELCRPAMADGLPVLAVERDPEDTLRELERLNREIPLDDLERAERISDYVASHLDRAWFIQRCGTPREPRLSPPAFRYNLVKRAQAANRRIVLPEGSEPRTVQAAAICQRRGIARCVLLARPEEVQAVARAQGIELPAGLEIVDPEQIRERYVEPMVELRRHKGLSAPAARAQLEDNVVLGTLMLALDEVDGLVSGAVHTTANTIRPALQLIKTAPGCKLVSSVFFMLLPEQVLVYGDCAVNPDPSAEELADIALQSAASAQAFGIPPRVAMISYSTGASGEGADVEKVREATRLARQARPDLPIDGPLQYDAAAIAEVARQKAPDSTVAGRATVFVFPDLNTGNTTYKAVQRSANCVSVGPMLQGLRKPVNDLSRGALVDDIVFTIALTAIQAETAAG

SEQ ID NO: 1699 - protein, 705 aa, Deinococcus deserti VCD115
MKTLFVAPTRNGVGLSSTALGLMRALERQGLKVAFLKPIAQTHEADTDDSVHFARVLAHAVTPEPIPLAVAEEQLSLGGSEELMENVIALAREASLTGPDGVATDVLIAEGLALNERNLYAGALNASLARNLEAETVLVSSLSEVTPGVLADELEIAAQSYRRSDGSGLAGYVLNFAPTELDFGSLMAELRARSRVLASGELPLLGVVSVSPGLAAPRTLDVARYLGAEVINEGEARLRRVTSTVVTARTVPKMASLFTPGALVVTPGDREDVVMAASLAHLSGVPLAGLMFTSGSAPEDSIERLCRAALSSNLPVLRVATNSFHTASNLSRMDPRVPHDDTERMDRMLEFIADRLDTVPLGTRLRTPQEGRERRLPPSAFRYELIQKARAANKRIVLPEGDEPRTVRAAIRCIEKGIARCVLLAKPDRVRQVAEGQGLSLPEGLEVLDPDSIRGRYVEPMVELRRHKGLTAPQAEAQLEDTVVLGTMMLALDEVDGLVSGAVHTTANTVRPALQLIKTAPGAQLVSSIFFMLMPEQVLVYGDAAINPNPNAQELADIALQSAESARAFGIPVRVAMLSYSTGESGSGEDVEKVKEATRLVRERHPDILVDGPLQYDAASVLNVGQQKAPNSPVAGRATVFIFPDLNTGNTTYKAVQRSAGVVAVGPMLQGLRKPVNDLSRGALVDDIVFTIALTAIQATQGRDA

SEQ ID NO: 1700 - protein, 703 aa, Deinococcus geothermalis DSM 11300
MKTLFIAPTRNGVGLTSTALGLLRALERQGLKVAFLKPIAQTHEAAPDDSVHWARTLAHAVTPDPILLSVAEEQLSQGQEEELMENVVALAREAAAGVTGGADVLVVEGLALNERNVYAGPLNASLARNLEADVVLVSSLAGVTPATLADELEIAAQAYRRSDGSGLAGYVLNFAPLELDFGGLLADLRARSRILASGELPLLGVIAQSPTLAAPRTLDVARHLGAEVLNEGEARLRRVTSTVVTARSVPKMADLFTSGALVVTPGDREDVVMAAALSHLSGVPLAGLLFTSGSTPEAAIERLCRAALTSTLPVLRVETNSYNTASRLSRMEARVPHDDLERMERTLDFIADRLDTVPLGTRLRAPEGSERRLPPSAFRYELIQKARAANKRIVLPEGDEPRTVRAAIRCVEKGIARCVLLAQPEKVRQVAEGQGLTLPDGLEIIDPDRVRANYVAPMVELRKHKGLTAPQAEAQLEDNVVLGTMMLALDEVDGLVSGAVHTTANTVRPALQLIKTAPGVRLVSSIFFMLMPEQVVVYGDAAINPNPNAEELADIAIQSADSARAFGIPPRIAMLSYSTGESGAGADVEKVRIATRLVRERRPDLPVDGPLQYDAASVLSVGRQKAPNSPVAGRATVFIFPDLNTGNTTYKAVQRAAGVVAVGPMLQGLRKPVNDLSRGALVDDIVYTIALTAIQATQAREGA

SEQ ID NO: 1701 - protein, 722 aa, Deinococcus radiodurans R1
MAGPIPFFLPLSPPVPKESRMKTLFLAPTRNGVGLSSTALGLARALERQSLKVAFLKPIAQTYEPRTDDSVHFARAVAHLTTPDPIPLTRAEELLSQGGEEDLMEQVIALAREAAGEGSDVLIAEGLALNERNVYAGTLNARLARNLEADTVLVSSLAGVTPAELADELEIAAQGYRRSDGSGLAGFVLNFAPRELDFGSLMAELRSRSRVLASGELPLLGVVSLDPALRQLRTLDVARALDAEIINAGEAESRRVSSTVVTARSVPQMTNLFTSGALIVTPADREDVIMAAALSHLSGTPLAGLMYTSGSAPEATIQQLCEVALTSSLPVLRVPTNSFETASRLVHLDFRVPHDDPRRMDRMLDYIADRLDTVPLGARLRAPGVAGERRLPPSAFRYELIQRARAANKRIVLPEGDEPRTVKAAIRCTEKGIARCVLLAPPEKVRQVAQGQGLELPEGLEIIDPETVRGKYVAPMVELRKSKGLTEPQAEAQLEDSVVLGTMMLALGEVDGLVSGAVHTTASTVRPALQLIKTAPGSSLVSSVFFMLMPEQVLVYGDAAINPDPNAQELADIAIQSADSAHAFGIPVRVAMLSYSTGESGSGEDVEKVKEATKLVRERRPELLVDGPLQYDAASVPSVGRSKAPDSPVAGRATVFIFPDLNTGNTTYKAVQRSAGVVAVGPMLQGLRKPVNDLSRGALVDDIVYTIALTAIQATQSAADCG

SEQ ID NO: 1702 - protein, 683 aa, Rhodoferax ferrireducens T118
MRTYFLAPTQPNVGLTSVSLGLLRALQRRGLKVAFVKPITKRTADTEPSVLFARSICHLQNTPDPLPMSLVTQRVSSGQTDELLEEIVSLAMSCTKEADVLLVEGIHADPSRIFIPRLSGQIARSLQADVVLVASAADAQGIAETNYLIAQIRNVGRNVVGVIFNRAPADFDEAAAAMQLDGVPIWGVVKNNPALSAPRMIDVARHLGAEVMIEGDIATRRMLETVLCGRSVAEVIPRLKPGTLVVTAGDRDDVILATALAASNGVELAGLMLTHHSAISPRIERFASLAFHSGLPVLRTDGDSYETAASISRLPLAVPQDDLARMDNVIESVAEQLDGNMIFAGLERAAPARVSPPAFRHQLIQKARAANKRIVLPEGDEPRTIRAAVICTEKGIARCVLLGKRKVIHSVADALGIELPKGLEILEPSEIAERYVAPMVELRKSKGLTPGQALVALEDTVVLGTMMLAVGEVDGLVSGAVHTTASTVRPALQLIKTAPGSSIVSSCFFMLMPEQVLVYADCAINPNPTAQELADIAKQSADSALAFGIEPKVAMISYSTGESGSGDDVEKVRTATALAHARWPELVLDGPMQYDAAAVREVGEQKAPGSAVAGQATVFIFPDLNTGNTTYKAVQRSAKVVSVGPMLQGLRKPVNDLSRGALVDDIVFTIALTAIQAEAMARQ

SEQ ID NO: 1703 - protein, 716 aa, Rhodopseudomonas palustris BisB18
MTAMNTLPRHRTFYLVPVSRDAGLTSVMLGLVRALQLTGVRVGVVKPVAQPEAHAGDLDLAPHFARTLCGVAAPDPIAFDHAAEMVRSGQLGGLMEEVVSMVETVRADCDVVIVEGLIPDVDFQIATRLNIEIIRSLGADLIPVLAGGAHSAAALAAKAAAAAEQYGDDGRRPIAGLLINRCADAAAATALSALGALTLKGSATPVRILAAVPSAAHLRAPRLIDIAEDLGLSILNRGDIESSRVQTVVVAARSAEKLLGDLRPGTLVVTPADRSDAILATALVAQRGMPLAGFVFTCGGRPAPEVAAVLAAAPLDRLALLCTEDDTFITASKLANLSAHVNRADADRMERVISFIAEQVDTAPLADRLNLPVDGLMPPPVFRHRLVERARAASRRIVLPEGEEPRTIRAAAICAEKRIARCVLLGAPDRIREVAAAHGIDLPDDIEIVDAEQQRSRYVAPLVERRKAKGLTKLQAEIMLEDAVVLGTMMLAEDDVDGLVSGAIHTTASTVRPALQLIKTAPGSSIVSSVFFMLMPDQVLVYGDCAINPDPTADELAEIAIQSADSAAAFGIEPRVAMISYSTGASGAGEDVDKVRRATDKVRALRPDLIVDGPIQYDAATVESVGRQKAPGGPLDGRANVFIFPDLNTGNTTYKAVQRSANVISVGPMLQGLRKPVNDLSRGALVDDIVYTIALTAIQAAARDADNRPAAAQAAE

SEQ ID NO: 1704 - protein, 711 aa, Rhodopseudomonas palustris BisB18
MNTPSRHRTFYLVPVSRDAGLTSVTLGLVRALHLTGLRVGFVKPIVQPEVRSGDLDLAAHFARTLCGASAPDPISIDHAAEMVRSGQLGGLMEEVVSMVDTVRADCDVVIVEGLIPNVDFQIATRLNIEIIRSLGADLIPVLAGGAHSAAALAAKAAAAAEQYGDDGRRPIAGLLINRCADAAAATALSALGALTLKGYSTPVRILAAVPNAAHLRAPRLIDIADDLGLSILNRGDIESSRVQTVVVAARSAEKLFGDLRPGTLVVTPADRSDAILAAALVAQRGMPLAGFVFTCGGRPAPEVAAVLAAAPLDRLALLCTEDDTFITASKLANLSAHVNRADADRMERVISFIAEQVDTAPLADRLNLPVDGLMPPPVFRHRLVERARAAIRRIVLPEGEEPRTIRAAAICAEKRIAHCILLGAPERIREVAAAHGIDLPDSVEIVDAEQQRSRYVAPLVELRKAKGLTKLQAEIMLEDAVVLGTMMLAQNDVDGLVSGAIHTTASTVRPALQLIKTAPGSSIVSSVFFMLMPDQVLVYGDCAINPDPTADELAEIAIQSADSAAAFGIEPRVAMISYSTGASGAGEDVDKVRRATDKVRALRPDLIVDGPIQYDAATVESVGRQKAPGGPLDGRANVFIFPDLNTGNTTYKAVQRSANVISVGPMLQGLRKPVNDLSRGALVDDIVYTIALTAIQAAARDAGGKLAAAAE

SEQ ID NO: 1705 - protein, 713 aa, Rhodopseudomonas palustris BisA53
MNTPFRHRTFYLVPVSREAGLTSVTLGLVRALQLAGVRVGYVKPIVQPEVRSGDLDLAAHFARTLCGASTPEPIPFDHAAEMVRSGQLGGLMEEVVSMVETVQPDCDVVIVEGLIPDVDFQIATRLNIEIVRSLGADLIPVLAGGTLDADGLAEKAAAAAEQYGDDGRRPIAGVLINRCADAAAAAALTEVGALTLNGASTPVPILAAVPNAEHLRAPRLIDIAQELELKILNRGDIETSRVQALLVAARSPEKLLGHLRPGTVVITPADRSDAILVTALVAQRGMPLAGFVLTCGGRPAPEVSAILAAAPLDRLPILGTDDDTFTTASRLASLSAHVSRADGDRMERVISFIAEKVDTGPLARRLNLPVDALMPPPVFRHRLVEAARAANRRIVLPEGEEPRTIRAAAICAEKRIAHCILLGAPDRIREVAAAHGIDLPDNVEIIDAEQHRSRYVAPLVELRKAKGLTRLQAEIALEDSIVLGTMMLAENHVDGLVSGAVHTTASTVRPALQLIKTAPGSSIVSSVFFMLMPDQVLVYGDCAINPDPTADELAEIAIQSADSASAFGIEPRVAMISYSTGASGAGEDVDKVRRATIKVRALRPDLIVDGPIQYDAATVESVGRQKAPGGPLDGRANVFIFPDLNTGNTTYKAVQRSANVISVGPMLQGLRKPVNDLSRGALVDDIVYTIALTAIQAAAGDAGAKSAVAAAAE

SEQ ID NO: 1706 - protein, 692 aa, Burkholderia oklahomensis C6786
MALGLVRSLQLAGVRVGFVKPIAQPEASTRDRDLSSHFARTLCGTTTPEPIPFAHAAEMVREGCLAGLMEEVVAIVESAREGNHVMIVEGLIPYVDAMISTRLNIEMIRSMGADLVPVVTGGTRGATELAAIAAGAAEQYSNGGRRPLAGVLINRCRGANASALGKLTSLHLERSAREVPILAAVPTNVQLTAPRLIDVAAGLDLTVFRSGDIETARVENFVVAARSPEKLIPHFKSGTLVVMPVDRSDAILAVAFTALRGMPLAGLILTCGGEPDPEAIKLLEAPPLDRLPVLLSDEDTFTVASRLTGLSSHVFADDAVRMERVLDFIAGNVHVEPLVARLDAPVETLMPPPVFRHRLVGKARSADRRIVLPEGDEPRTIHAAVICAEKGIARPMLLGAPDTIRSVAAGHGIELPKSVEILDPETIRDAYVEPMVELRKSKGLTALQAAKQLEDTVVLGTMMLARGDVDGLVSGAVHTTANTVRPALQLIRAAPGNSVVSSVFFMLMPDQVLVYGDCAINPDPSAEELAEIAIQSADSAKAFGIDPRVAMISYSTGSSGSGDDVEKVRAATALVRERRPDLVIDGPMQYDAATVEAIGKQKAPGSPVAGRANVCIFPDLNTGNTTYKAVQRSANVVSVGPMLQGLRKPVNDLSRGALVDDIVYTIALTAIQAAAGGGNPNRAVPPAPAVAA

SEQ ID NO: 1707 - protein, 703 aa, Rhodospirillum rubrum ATCC 11170
MPARMFFLAPMAQDVGLTSVALGLARALQRDGIKVGFAKPIGHAEADGEPGDPSSHFARSLCLLEAPESIAFARAEDQVRRGDLAALMEEVVTLVDGLRASHDAVIIEGLIPGADTQVAGRLNAEMARALGADLIPVLSGAGRDGADLAEAIALARRQYDGAQNAAFAGVLINKVSPSHGAELRGDLERAVGERLPILATIPFETRLQSPRLADVVRGLGLTVEHEGALAQTRVREIVIAARSVENIIERLRPGALVVTPVDRIDIVLAATLASLRGVPLAGVLLTCGGSLPDTVASLVLSARPEGLPILSTPADTYATASRLSRLSGHVGADDHAQMEEVIDFIAEQIATAPLRRRIGEPGEVRMSPPAFRNRLIQSARRAAKRIVLPEGDEPRTLQAAIACHAKGIARCVLLGHPAQVRQVASAQGLEIPADLEILDPELVRGRYVEALVEMRRAKGLTALQAAAQLEDTVVLGTVMLALGEVDGLVSGAVHTTASTVRPALQLIKTAPGASIVSSVFFMLMPDQVLVYGDCAINPNPTAEQLADIAIQSADSALAFGIEPRVAMISYSTGSSGVGDDVEKVRAATALAKLKRPDLMIDGPMQYDAASVESVGRQKAPDSPVAGRANVFVFPDLNTGNTTYKAVQRSANVVSVGPMLQGLRKPVNDLSRGALVDDIVYTIALTAIQADQGADPMAEKVAAE

SEQ ID NO: 1708 - protein, 687 aa, Rhodopseudomonas palustris BisB18
MTKIKHPRGLFVAPASSDFEVSAISLGLVDSLRARGLAVGYVKPIGDPGAMLNDRSSAFARRMFGLKTPEAIPAERAEQMIIAGRSATLLEEVVALVSELGDDLDIVVVEGAALADGHGLLAEFGFAVARNLSADVIPVISGRDSGAARIGGALIDAVHRAGGAESCAGAIVIRCPDGELAPLRDLSLPVRLLGVLPEDPGLAAPRLSDVVADLGFEVLHSGQLADARMRDVIVAARGPEHIVDLLRPGTLVVTPGDRHDVVITTALASTSGMPIAGLLLTCAAAPTDSLNAFLMPRFGGLTVLKTELQTFEAAMKLGEFDRGVRSDDARRMERLIAHASENLDLSLMSTASKRSSGEAMPPPVFRHKLIRAARAAARRIVLPEGDEPRTLAAAADCTRRGIAHCVLLGECSEVRNVAARYGVDLPGDIEILDPASLRASYVEPMVRLRKSKGLTPEEALSQLEDNVVLATMMLAEGHVDGLVSGAVHTTASTVRPALQLIKTAAGSSLVSSVFFMLMPDQVLVYGDCAVNPDPTAEQLAEIAVQSADSAAAFGIEPRVAMISYSTGESGTGGDVDKVRAATEIVRKLRPELAVDGPIQYDAATVESVGRQKAPGSPVAGRANVFVFPDLNTGNTTYKAVQRSADVISIGPMLQGLRKPVNDLSRGALVDDIIYTIAITAMQAAQAK

SEQ ID NO: 1709 - protein, 693 aa, Chromobacterium violaceum ATCC 12472
MQTFFLAPTGFNAGLTSVTLGAIRSLEQAGLRVGFVKPIAQDTKDGEAERSTHFAQAICRLNPPQPISMERVEYLLSQGQVDQLMEEVVSLYQQAAQNVDAVIVEGLVPDQKQVFSTFLNTKIARNLQAQTILVSSVKELGAAEIAEQLEMNIQAFGSQAIAGYILNHVLPAVDRAELAREVRESGNLKKAGLPLLGVIPYQSELLAPRTQDVARYLNANVVHAGQQASRRVRNMVVAARTAPNIVNLLKPGALIITPGEREDVVMATSMAAMNGVPLAGLLLTCDSQPDPRIQQLCQQAFTGGLPVLATSLNSMETAGALNAMSHQVPSDDLERMEKVIEHVAEFLDVSSLKQSVGEPRELRLPPPAFRFQLMEKARKANKRIVLPEGNEPRTIQAAAICQEKGIARCVLLGNRAEILQVAETQGVTLPESVEILDPNEIRGRYVEPMVELRKGKGLNAPMALAQLEDTVVLGTMMLAMNEVDGLVSGAVHTTANTIRPALQLIKTAPGSSIVSSVFFMLMPEQVYVYGDCAVNPDPTAEQLADIAIQSADSAVAFGINPRVAMISYSTGSSGSGSDVEKVREATRIAQEKRPDLLIDGPMQYDAASVESVGRQKAPDSQVAGRATVFVFPDLNTGNTTYKAVQRSANVVSVGPMLQGLRKPVNDLSRGALVDDIVYTIALTALQAEQTPAS

SEQ ID NO: 1710 - protein, 695 aa, Lutiella nitroferrum 2002
MQTFFLAPLGFDAGLTSVALGMIRALEQAGLRVGFVKPIAQGAGHHEPERSTHFARAICHLASPEPLTMERVEHFLSQGQVDQLMEEVVSLYQQAARNVDVVIVEGLVPDQKHPYSTFLNTRIARNLQAQTILVGAADKLASHEIAEQLEISIQAFGGDHGSTAGYILNRVSKQHDTAQMALEILESSQALQHNRLPLLGAIPLEPELLAPRTLDVANYLKARLVHAGQMTRRRVRSTVITARTVPNIVHLLKPGALIVTPGDREDIVLATAMASMNGVPLAGLLLTCDAMPDPRIQQLCHQAFTSGLPVLASESNTLETTSLLTNMSLQVPADDLERMEQVIDFVAEHLDAKALRNRVGAPREHRLPPPAFRFQLMEKARQANKRIVLPEGNEPRTIKAAAICHEKRIAQCVLIGSRAEIEQVAEAQGVALPADIEIMDPNEVRGRYIEPMIELRKNKGLNAPMAEQQLEDNVVLGTMMLALDEVDGLVSGAVHTTANTIRPALQLIKTAPEAKLVSSVFFMLMPEQVLVYGDCAVNPDPSADELADIAIQSADSAAAFGIPPRVAMISYSTGSSGSGDDVEKVREATRLAREKRPDLIIDGPMQYDAASVESVGRQKAPDSPVAGRATVFVFPELNTGNTTYKAVQRSANVVSVGPMLQGLRKPVNDLSRGALVDDIVYTIALTAIQADQQAG

SEQ ID NO: 1711 - protein, 715 aa, Psychrobacter sp. PRwf-1
MQTILLVPTGRGIGLTSAGLGLIKAFDYLGIKAGFMKPFLQDDSYDSQHTLDSSSELAHKAFGLTPPESIPRERVERMMNAGNVDDLMEDVVTNFHKLDDGYGVVVCEGLVPTEEVNYASQVNYALATALDAKVIFVSMADLENPKQLADKLDLHARAFGGLTGERTLGSILMRANNVPNTFDTQPVAPGEATLELDAEFIEAMQKYSPNFATEKYHLIGVVPFSNSLSVPRTWDIAQQLNATWLNQGEAKQRRVLKTSLAARTISRVGEIFNRGTLIVTPGDRDDLLLATAMAAMNGIPMAGIVLTGGIIPNDTVFELCQPALKTGLPIMSVPTNSLETVTNLFNISNEIPRDDVERAETVTRFVAAHLDLNWLKSYFERDYKPRLSPSAFRHQVVKKAQQAKMRVVLPEGEEPRTIEAAAICQSRGIAQCVLIGNSDEIAQVAKNRGVDLPKDIEIIDPATLNLDKYVAAFVERRKGKASPEQAAEQLKDTVVLGTTMLHMDEVDGLVSGAIHTTANTVRPAFQLIKTAPQYSLVSSIFFMLLPEQVVVYGDCAINPDPNAEQLAEIAIQSAASAKAFGIEPKVAMISYSTGASGTGDDVEKVKQATQIVRERAPDLMVDGPLQYDAASVLSVGKQKAPDSPVAGQANVFIFPDLNTGNTTYKAVQRSANVVSVGPMLQGLNKPVNDLSRGALVDDIVYTIALTAIQASSSEI

SEQ ID NO: 1712 - protein, 718 aa, Psychrobacter cryohalolentis K5
MQTILLVPISRGIGVTSAALGLIRAFDYNGIKAGFMKPFLQDDTLDKQNSLDSSSALAMHAFGLKPPKSISRQHVERMIGDDNLDDLMEEVVVNYHTLGDDYDVVICEGLVPTTETSYASQINRAIAHALDARIIFVSTADTSKPAYLADKLDVHAREFGGMASDRTLGCILMRMHDLPNTQSTLENQIVAPGEAIVSLDSGFIQEVQRLSPHFNTEQFRLIGVVPFSDSLSVPRTWDIAAELDGTWLNVGEAKSRRINRISLTARSVARVDEVFKRGTLIVVPGDRDDLLLAAGLACINGIPLAGLVLTGGVVPSPTVAELWQSALKTGIPVMSVEDDSFETVQSLLHMSAEIPSDDTERAEEVARYVAAHLDLSWIKAYFSQNHEPRLSPSAFRHQVVKKAQIAKKRIVLPEGSEPRTVEAACICQSRGIANCVLLAKRADVEQVAKNRDLVLPEGLEIIDPDSLDMSKYIAAVVERRKGKTSAEVAAEYLQDTVYLGTTMLQMDEVDGLVSGAIHTTANTVRPAFQLIKTAPEYSLVSSVFFMLLPEQVVVYGDCAINPDPNAEELAEIAIQSAQSAAAFGIDPKVAMISYSTGSSGTGADVEKVARATQIVRERAPNLKVDGPLQYDAASVMSVGKQKAPDSPVAGQANVFIFPDLNTGNTTYKAVQRSANVVSVGPMLQGLNKPVNDLSRGALVDDIIYTIALTAIQAHSDVI

SEQ ID NO: 1713 - protein, 714 aa, Enhydrobacter aerosaccus SK60
MQTILFVPTSSGIGLTSACLGFIRALDYIGLKAGFLKPFSQNTTANHESDDSSSVLAKHAFNLNPPTSIDRSRLERVIGDGQLDDLMEEVVAKHQALAEQYDVIVCEGLAADNDSSYAELVNLAIVNALDAKVILVSSGDIANPDSLVDKLDIFARDFGGMASERTLGTILMRVKNVDNHYDEAPVAPGKAKVDLAAEQLQAIKSHSPYFDSDKFRLIGVVPFSNTLSVPRTWDVARELDAKWLNEGDAKNRRVLNTLLVARTVANIEDSFTRGNLLVTAGDRDDLILATALSTMNGVPLAGLILTGGIVPNQKIINLCRPALKTGIPVMLVDTDSFDTVTKLNHISHEIPADDTTRASEVTDFVAAHLDLDWIKTTFSQGNNNRKLSPSAFRHTLVKKAQAAKKTIVLPEGNEPRTVEAAVICQNRGIAHCILLAKRSEVEEVAKNLGLTLPEGLQILDPESLIDKYVKPMVERRKGKLDELQAREQLKDTVVLGTMMLHLGEVDGLVSGAVHTTANTVRPAFQLIKTAPQYSLVSSIFFMLLPEQVVVYGDCAINPDPTAEQLAEIALQSAQSAKAFGIEPKVAMISYSTGSSGEGADVDKVRQATEIAKAKAPDLLIDGPLQYDAASVASVAKSKAPNSLVAGQANVFIFPDLNTGNTTYKAVQRSANVVSVGPMLQGLNKPVNDLSRGALVEDIVYTIALTAVQADSGEF

SEQ ID NO: 1714 - protein, 714 aa, Acinetobacter radioresistens SK82
MNTILLIPTGEGVGLTSACLGMIYALDCNGIKAGFLKPFSESFQENDQNRTTSLFEHLFQTSTVEPIAYERVSQLIALEEMDELLEEAVSLHRSIATKHDVIIVEGLLPNHEDQFAGELNAALAQALDAKVILVSTADVQNPRKTAEKIEAHLRQFGGAASERTAGVLFMRTKGLPEEVAQIPVTIDPSLRLSAEIATFTIELQKYNRYLGTADLPIIGLVPFSNTLSVPRTLDIARLIQGEWIHQGEARQRRVLHSSLITSSIEYELNKFVAGELIISASERTDVLLASSLATSHGIPLAGLVLTERQAPNAQILNFCQNAIKQGLPILHTQLTTLETAQRLANLSNEIPVDDTERAEQVTRFVSSHIDLDWLTQQINGNATPRLSPSAFRHELVQKSIAAKKRIVLPEGDEPRTIQAAAICQSRGIAHCILLAKPEAVLEIAKARNIELPDDLEIIDPDTIRSQYISSMVELRKGKINDIQAKEQLQDTVVLGTMMLALDQVDGLVSGAVHTTANTVRPAFQLIKTAPEYSLVSSVFFMLLPDEVYVYGDCAINPDPDAQQLAEIAIQSADSARAFGIDPRIAMISYSTGTSGTGADVDKVREATEIARQRRPDLLIDGPLQYDAASVESVGRQKAPESPVAGRANVFIFPDLNTGNTTYKAVQRAANVVSVGPMLQGLNKPVNDLSRGALVDDIVFTIALTAIQAEQQATV

SEQ ID NO: 1715 - protein, 720 aa, Acinetobacter sp. ADP1
MNTILMIPTGEGVGLTSACLGLIYALDCNGIKAGFLKPFSQELPNQVDRTTSLFSHLFQGKTVTSISHEKVLQRLALGERDELLEEAVSIHRNVAANYDVIIVEGLLPNAQDHFATELNAALAQALDAKVVLVSTADVQNPRRTAEKIEAHLHHFGGVSSNRTAGVLFMRTRGLPEETAQIPLTIDPSLRLNTEIAAFSQELQRYNRNLGTTTLPIIGLVPFSNTLSVPRTLDIASIIEGDWIHQGEARHRRILHSSLIASSIEYELNKFVAGELIISASERTDVLLASSLATSNGIPLAGLVLTERKAPNPQILDFCQHAIKQGLPILHTQLNTLETAQRLADFGNEIPVDDTERAEQVTRFVSSHIDTAWLNSQINTGVQPRLSPSAFRHELVQKSIAAKKRIVLPEGDEPRTVQAAAICQSRGIAHCILLAKPEAVVEVAKARGIELPDDLEIIDPDLIRNQYITPMVELRNGKLNELQAKEQLQDTVVLGTMMLALDQVDGLVSGAIHTTANTVRPAFQLIKTAPDYSLVSSVFFMLLPDEVYVYGDCAINPDPDADQLAEIAIQSADSAKAFGINPRIAMISYSTGTSGAGADVEKVAKATEIAKQRRPDLLIDGPLQYDAASVESVGRQKAPDSQVAGRANVFIFPDLNTGNTTYKAVQRSANVVSVGPMLQGLNKPVNDLSRGALVDDIVFTIALTAIQAEQQLEAKAAALAS

SEQ ID NO: 1716 - protein, 714 aa, Acinetobacter sp. RUH2624
MNTILLIPTGEGVGLTSACLGMIYALDCNGIKAGFLKPFSQVDQENLDRTTSLFGHLFQGKTVQSISHEKLTQRIAAGEVDELLEEAVSLHRSIAADNNVIIVEGLLPNGQDHFASELNASLAQALDAEVVLVSTADIQNPRKTAEKVEAHLRQFGGATSNRTAGVLFMRTRGLSEETAQIPVAFDPSLRPTEDIAKFTTELQKYNRYFGSNDLPIIGLVPFSNTLSVPRTLDIANVIDGQWVHQGEAKTRRILHSSLIASSIEYELNKFIAGELIISASERTDVLLAGSLATSNGIPLAGLVLTEREAPAPELLEFCQSAIKQGLPILHTRLNTLETAQRLSDFGNEIPIDDTERAEQVTRFVSSHIDVEWLKQHSNNGATPRLSPSAFRHELVQKSIAAKKRIVLPEGDEPRTIEAAAICQARGIAHCILLAKPDAVQDVAKARGIELPADLEIIDPDSIRNQYVAPMVELRKGKLNELQAKDQLQDTVVLGTMMLALDHVDGLVSGAVHTTANTVRPAFQLIKTAPSYSLVSSIFFMLLPDEVYVYGDCAINPDPTADQLAEIAIQSADSAKAFGIDPRIAMISYSTGTSGTGADVEKVQQATQIAQQRRPDLLIDGPLQYDAASVESVGRQKAPNSPVAGRANVFIFPDLNTGNTTYKAVQRAANVVSVGPMLQGLNKPVNDLSRGALVDDIVFTIALTAIQAEQQAAAK

SEQ ID NO: 1717 - protein, 710 aa, Acinetobacter sp. ATCC 27244
MNTILLIPTGEGVGLTSACLGMIYALDCKGINAGFLKPFSQIAEATVDRTTTLYHHLFQHHAVEPMTYDRLTQLIALGETDELLEEAVALHRQIAAHHDVIIVEGLVPNGQDHFVSEINAALAQALDAQVVLVSTADLSDPRKTAERIDAHLRQFGGAASARTTGILFMRTKGLPESTAQIPVTLDPSLRLGEKIDRYAVELQRYNRHIGTEALPIIGLVPFSNILSVPRSLDIAPIVNGTWLHQGEAKHRRILHTSLIASNIESELHKFVPGELIIGASQRADILLAASLASSNGTPLAGLVLTEPSPPAANVLEFCQSAIKQGLPVLHTSLTTLEALKKLSRFGNEIPIDDTERAEQVTRFVSSHIDSQWLDQHTQNNLHPRLSPSAFRYELVQKSITAKKCIVLPEGDEPRTVQAAVICQNRGIAQCILLAKPESVAEVAKARGIQLPSDLKIIDPDTIRDRYIDPMVELRKGKLDALQAKAQLQDTVVLGTMMLALDEVDGLVSGAIHTTANTVRPAFQLIKTAPNYSLVSSVFFMLLPDEVYVYGDCAINPDPNAEQLAEIAIQSADSAKAFGLDPRIAMISYSTGTSGTGADVEKVAEATQIAQQRRPDLLIDGPLQYDAASVESVGRQKAPDSQVAGRANVFIFPDLNTGNTTYKAVQRAANVVSVGPMLQGLNKPVNDLSRGALVDDIVFTIALTAIQAAQQ

SEQ ID NO: 1718 - protein, 711 aa, Anaeromyxobacter sp. Fw109-5
MPRTLLVAPAGRQVGVTTVCLGLVRALDRLGVRVAFAKPIAARGENRAAALLKLGARVDSPEPIARAAAENLLATGDDQTLMERVVALCASAAEGADVLVVEGMAPEPGMVWSTRVNALMLKALDAELVIVGAPRGETPAELANAVSIAARGLGADVDGRGVGCILNRVTAGAASAGEARTHWFDAAVEAEDVPPSVLDGYADALRAEKLRPIGIVPSRSDLAAPRVKDLAGALGAKVLRAGDQDRRRIRSVALCAMSVPGSIKVFRPGTLIITPGDRSDIVVAASLAVLNGMPLAGLLLTGGVEPEEHVFAMCERALETGLPILAVKEGSYAAASAVAAMNLQIPPDDVERVERVMNTVADRLDREWLEGLGRTRRVRRLSPPAFRHRLVESARAADKRIVLPEGTEPRTIAAASIVQERGIARCVLLGNPDEIRDVARKQGVSLPASLELLDPAVIAPRYVEPLVERRRSKGMTPEMARSELGDTIMVGTMMMALDEADGLVSGALHTTAHTIRPALQIIKTVPGCDLVSSVFFMCLPEQVLVFGDCAVNPNPTAEQLADIAIQSADSARAFGIDPRVAMLSYSTGTSGTGADVEKVKKATELARAQRPDLAVDGPLQYDAAIVPDVGRQKAPKSDVAGRATVFVFPDLNTGNVTYKAVQRSANVVSIGPMLQGLAKPVNDLSRGCLVEDIVFTITLTAIQAQQRAAQR

SEQ ID NO: 1719 - protein, 714 aa, Anaeromyxobacter dehalogenans 2CP-C
MAHVLLLAPAGRQVGLTTACLGLVRALDRQGVRVAFAKPIAARGEDRVSALVRLGSSLRPPDPIPRAEADALLAAGDDQTLMERVVALCAGAAEGADVLVVAGMWPEPGMVHSTRVNALMLKALDAELVLVGSPRGETPAELADAMAIAARGLGGFGDGEPVSCFLNRVAPPAPAARVGESRPIWLEAGEEGELPAAEIEAYRAALEAERLRPIAAVPSRGDLAAPRVKDLAEAIGARVVRSGDLEGRRIRHVALCAMAVPGSIKTFRPGTLVITPGDRSDILLAAALAVLNGVPLAAVLLTGGVEPEPHVFEMCDSALRAGLPVLAVDQGSYAAATAVAGMNLQVPPDDAVRVERVMTAVADLIDPAWLRSRAATTRVRRLSPPAFRQRLVEAARAANKRIVLPEGAEPRTVAAAAIAQERGIARCVLLGDADEVHEVARRQGVTLPPSIEIVDPARVAPWYVAPLVERRAAKGMTAAQAAQELGDAVMVGTMMMALDEADGLVSGALHTTAHTIRPALQIVKTVPGCNLVSSVFFMCLPEQVLVFGDCAVNPTPTAEQLADIAVQSADSAAAFGIEPRVAMLSYSTGTSGAGEEVEKVKRATELARAARPDLAIDGPLQYDAAVMPDVARQKAPRSSVAGRATVFVFPDLNTGNVTYKAVQRSANVVSIGPMLQGLARPVNDLSRGCLVEDIVFTIALTAIQARQLAARRSR

SEQ ID NO: 1720 - protein, 712 aa, Mannheimia succiniciproducens MBEL55E
MSRTIILIPISAGVGLTSVSLGLIRALEQKGTKIGFMKPISQPRSGEDMLDRTTSIVRTSTTIETTEPVMLSEAENLIGQNQTDVLLEKIVAQHQQISKDNDIVIVEGLIPSRKNSYANSVNYDIAQALDAEIILVSAPATETPAQLKERVEAAAASFGGKSNPNLLGVVINKFNAPVDESGRTRPDLTEIFDSFQHSHNNIKEIYKLFENSPIKVLACIPWSADLIATRAIDLVKHLGASILNEGDMNRRIRSITFCARTLPNMIEHFKAGSLLVVSADRPEILTAAALAATTGIELGGILLTGGYKIDCEIKKLCNPTFENTKLPVFRIEGNTWQTALSLQSFNLEVPVDDKERIENIKQYTSGQFDADFIHSLASASVRARRLSPPAFRYQLTELARAAKKRIVLPEGDEPRTIKAAVLCAERGIAECVLLAKPEDVKRVADSQGVKLGNGITVIDPASVRENYVARLVELRKAKGMTEMAAREQLEDTVVLGTMMLEAGEVDGLVSGAVHTTANTIRPPMQIIKTAPGSSIISSIFFMLLPDQVLVYGDCAVNPDPTAEQLAEIAIQSAESAKSFGIDPRVAMISYSTGTSGSGADVEKVKEATRIAQEKRPDLLIDGPLQYDAAVMEDVARSKAPNSKVAGKATVFVFPDLNTGNTTYKAVQRSADLVSIGPMLQGMRKPVNDLSRGALVDDIVYTIALTAIQATQC

SEQ ID NO: 1721 - protein, 713 aa, Actinobacillus succinogenes 130Z
MSRTFILIPISGGVGLTSVSLGLIRSLEQKGAKIGFMKPISQPSTGEDKIDRTTSIVRTSTQLETAEPVMLSVAENLIGQNQTDVLLETIVAAHQELSKNNEIVIVEGLIPNRKHSYANSINYEIAQALDAEIILVAAPSTETPAQLKERVEASASLFGGKNNPNLLGVVINKFNAPVDESGRTRPDLTEIFDSFQHSHNNSAEVFKLFEQSPIKVLACIPWSADLVATRVIDLVKHLGAAIINEGEMKTRRIRGITFCARSLHHMVEHFHAGDLLVTSADRADVLAAAALAVTNGIELGGILLTGGYKIDNEINKLCQRAFETTGLPIFRIEGNTWQTALSLQSFNLEVPVDDKIRIENIKEYTSRQFDAEFIHQIAGTSARVRRLSPPAFRYQLTELARAAKKRIVLPEGDEPRTVKAAALCAERGIADCVLLANPEDVKRVASAQGVSLDKGITVIDPATVRENYVARLVELRKAKGMTEEAAREQLEDNVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGAGADVEKVKEATRIAQEKRPDLLIDGPLQYDAAVMADVAKSKAPNSPVAGKATVFVFPDLNTGNTTYKAVQRSADLVSIGPMLQGMRKPVNDLSRGALVDDIVYTIALTAIQATQA

SEQ ID NO: 1722 - protein, 711 aa, Aggregatibacter aphrophilus NJ8700
MSRTIILIPISTGVGLTSVSLGLINALEQKGAKVGFMKPISQPNTGEDVIDRTTSIVRSSTALETAEPFMLSVAESLIGQNQSDVLLEKIVENHQRLSKNNEIVIVEGLIPTRKHSFANSINYEIAQALDAEIVLVAAPATETPAQLKERVEAAASLFGGKGNKNLLGVIVNKFNAPIDESGRTRPDLSEIFDSFQHSHNSESELVKLFAQSQIKLLACIPWSADLIATRAIDLIKHLGASILNEGDVNRRIRGITFCARSLPNMVEHFRAGSLLVVSADRPDVIVAAALAVSNGIEIGGLLLTGGYKLDPQIKKLCQHVFESKKLPVFRIEGNTWQTALNLQSFNLEVPVDDKERIENIKRYTSEKLDASFVNGLVEASGRLRRLSPPAFRFQLTELARAANKRIVLPEGDEPRTIKAAILCAERGIAECVLLAKPDDVKRVAESQGVKLVKGITVIDPASVRENYVARLVELRKAKGMTETMAREQLEDNVVLGTMMLEANEVDGLVSGAVHTTANTIRPPMQIIKTAPGSSIISSIFFMLLPDQVLVYGDCAVNPDPTAEQLAEIAIQSAESAKSFGIDPKVAMISYSTGTSGSGADVEKVKEATRIAKEKRPDLLIDGPLQYDAAVMEDVARSKAPNSPVAGQATVFIFPDLNTGNTTYKAVQRSADLVSIGPMLQGMRKPVNDLSRGALVDDIVYTIALTAIQATQ

SEQ ID NO: 1723 - protein, 711 aa, Haemophilus influenzae 3655
MSRTIILIPVSTGVGLTSISLGLIHSLEQKGTKVAFMKPVSQPSTGEDKLDRTTSIIRTSTSLETAEPFMLSVAESLIGQNQSDVLLEKIVANHQQLTKNNDIVVVEGLIPTRKHGYANSINYEIAQALDAEIVLVAAPATETPTELKDRVEAAASLFGGKNNPNLLGVVVNKFNAPVDESGRTRPDLAEIFDSFQHNHISETEVNKLFAGSAIKLLACVPWNANLIATRAIDLVKHLGASIINEGEINRRIRGITFCARSLSNMIEHFRAGSLLVASADRPDVIVAASLAAANGIEIGGILLTGGYKIDAQINKLCRPTFEKAKLPIFRIEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 1724 - protein, 712 aa, Haemophilus somnus 129PT
MSRTIILIPISTGVGLTSVSLGLIHALEQKGAKIGFMKPISQPSTDEDKLDRTTSIVRTSTTLETAEPFMLSVAENLIGQNQSDVLLEKIVENHQQLAKNNELIIVEGLVPTRKHGYANSINYEIAKALDAEIVLVAAPATETPAELKERIEAAASQFGGKNNPNLLGVIINKFNAPIDESGRTRPDLSEIFDAYQHKQNNLNEVYKLFEKSPIKVLACVPWNAELIATRAIDLVNHLGASILHEGDIKTRRIRSITFCARSLQNMVEHFKTGSLLVTSADRPDVLTASALAATNGIELGGILLTGGYKIDNQIKKLCQPVFENTGLPIFRIEGNTWQSALALQSFNLEVPVDDKERIENIKQYTSQQFKSSFIENLVAASTRPRRLSPPAFRFQLTELARAAKKRIVLPEGDEPRTVKAASLCAERGIAECILLANPDDVKRVADAQGVVLGKGITIIDPVSVRENYVDRLVELRKAKGMTETSAREQLEDTVVLGTMMLEANEVDGLVSGAIHTTANTIRPPMQIIKTAPGNSIVSSIFFMLLPDQVLVYGDCAVNPDPTAEQLAEIAIQSADSAKAFGIDPKVAMISYSTGTSGSGADVEKVKEATRIAQEKRPDLLIDGPLQYDAAVMEDVAKSKAPNSPVAGKATVFVFPDLNTGNTTYKAVQRSADLVSIGPMLQGMRKPVNDLSRGALVDDIVYTIALTAIQATQ

SEQ ID NO: 1725 - protein, 712 aa, Pasteurella multocida subsp. multocida str. Pm70
MSRTIILIPISAGVGLTSVSLGLTHALEQKGAKVGFMKPISQPNSGEDMIDRTTSIIRTSTTIETSEPFMLSVAESLIGQNQSDVVLEKIVENHQQLAKNNEIVVVEGLIPTRKHSYANSINYEIAQALDAEIILVAAPATETPAELKERIKAAASLFGSKNNPNLLGVVINKFNAPIDESGRTRPDLAEIFDSFQHTQNQVSEIYHLFEKSPIKILACIPWSAELIATRAIDLAKHLGAAIIHEGAINERRIRGITFCARNLTNMVEHFRVGSLLVTSADRPDVIVAAALSAMNGVEIAGVLLTGGYKIDAQIKKLCQHAIESTGLPVFRVEGNTWQTALALQSFNLEVPVDDKERIEKIKHYISDLLDSNFIDSLAAASSRLRRLSPPAFRFQLTELARQAQKRIVLPEGDEPRTVKAAALCAERGIAECVLLATPESVMRVAEAQGIQLGKGITIIDPATVRENYVARLVELRKNKGMTEDSAREQLEDNVVLGTMMLEANEVDGLVSGAVHTTANTIRPPMQIIKTAPGNSIVSSIFFMLLPDQVLVYGDCAVNPDPTAEQLAEIAIQSADSAKAFGIDPKVAMISYSTGTSGSGADVEKVKEATRLAQEKRPDLIIDGPLQYDAAVMEDVARSKAPNSPVAGKATVFIFPDLNTGNTTYKAVQRSADLVSIGPMLQGMRKPVNDLSRGALVDDIVYTIALTAIQATQ

SEQ ID NO: 1726 - protein, 712 aa, Pasteurella dagmatis ATCC 43325
MSRTIILIPISSGVGLTSISLGLIHSLEQKGAKIGFMKPISQPYSGEDTIDRTTSIVRTNTSLDTAEPFMLSVAESLIGQNQSDVVLEKIVENHQQLAKNNDIIVVEGLIPTRKHSYANSINYEIAQALDAEIILVAAPATETPAELKERIKAAASLFGGKNNPNLLGVVINKFNAPIDESGRTRPDLAEIFDSFQHTQNQVSEIYHLFEKSPIKVLACIPWSAELIATRASDLAKHLGAAIIHEGLINERRIRGITFCARNLTNMVDHFRVGSLLVTSADRPDVLVAASLAAMNGVEIAGVLLTGGYKIDAQIKKLCEHAIESTGLPIFRVEGNTWQTALALQSFNLEVPVDDKERIEKIKNYVSEQIDTQFIDSLVAASSRLRRLSPPAFRFQLTELARQAKKRIVLPEGDEPRTVKAAALCAERGIAECVLLANPDSVMRVAEAQGVQLGKGITIIDPVTVRENYVARLVELRKNKGMTEDSAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRLAKEKRPDLIIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 1727 - protein, 712 aa, Actinobacillus pleuropneumoniae serovar 1 str. 4074
MSRTIILIPTTTGVGLTSVSLGLVHALEQKGSKVGFLKPIAQPISGEDTLDRSTSIIRSAQTTEVGEPFMLSEAEALIGQNQSDVLLEKVVERHQQLSKNNEIVVVEGLIPTRKNSYANSVNYDIAQALDAEIILVAAPGSDKPTQLKERVEAAASEFGGRHNPNLLGVIINKFNAPVDESGRTRPDLTEIFDSFQHSTQNIAEVEALFAKSPIKLLACVEWKSDLIATRAIDLAKHLRAAIINEGELQTRRIRGVTFCARSLPHMVDHFKAGSLLVTSADRPEVLVAASLAVMNGVEIGAILLTGGYKIETPIAKLCQQAFESGVPVFRVEGNTWQTALNLQSFSLEVPADDKERISSIKEYVASQFNHGFIDEISKAATRARRLSPAAFRYQLTEYARQAKKRIVLPEGDEPRTVKAAALCAERGIAECVLLANPTDVQRVAESQGVVLGKGITIINPEEVRENYVARLVELRKNKGMTEVVAREQLTDTVVLGTMMLEAGEVDGLVSGAVHTTANTIRPPMQIIKTAPGSSIVSSIFFMLLPDQVLVYGDCAVNPDPTAEQLAEIAIQSAESAKAFGIDPRVAMISYSTGTSGSGADVEKVKEATRIAQEKRPDLIIDGPLQYDAAVMEDVARSKAPNSPVAGKATVFVFPDLNTGNTTYKAVQRSADLVSIGPMLQGMRKPVNDLSRGALVDDIVYTIALTAIQATQG

SEQ ID NO: 1728 - protein, 712 aa, Actinobacillus minor NM305
MSRTIILIPTTTGVGLTSVSLGLVHALEQKGTKVGFLKPIAQPITGEDTLDRSTSIIKASQTTEIGEPFMLSEAETLIGQNQTDVLLEKIVARHQALAKNNEIIVVEGLIPTRKNSYANSINYEMAQALDAEIVLVAAPGSDKPAQLKERVEAAASEFGGRHNPNLLGVVINKFNAPVDESGRTRPDLTEIFDSFQHSTQNVAEVEALFAKSPIKLLACVEWKADLIATRAVDLAKHLHAAIINEGELNTRRIRGVSFCARSLPHMVDHFRAGNLLVTSADRPEVLVAASLAVMNGVEIGAILLTGGYKIENSIAKLCQQAFETGVPVFRVEGNTWQTALNLQSFSLEVPVDDKERILAIKEYVASQLNSGFIEEVSKGATRARRLSPAAFRYQLTEFARSAKKRIVLPEGDEPRTVKAAALCAERGIAECVLLANPVDVQRVAEAQGVVLGKGITIINPADVRENYVARLVELRKAKGMTEESAREQLEDTVVLGTMMLEANEVDGLVSGAVHTTANTIRPPMQIIKTAPGSSIVSSIFFMLLPDQVLVYGDCAVNPDPNAEQLAEIAIQSADSAKAFGIEPRVAMISYSTGTSGSGADVEKVKEATRIAQEKRPDLIIDGPLQYDAAVMEDVARSKAPNSPVAGKATVFVFPDLNTGNTTYKAVQRSADLVSIGPMLQGMRKPVNDLSRGALVDDIVYTIALTAIQATQA

SEQ ID NO: 1729 - protein, 712 aa, Haemophilus ducreyi 35000HP
MSRTIILIPITTDVGLTSVSLGLVHALEQKGIKVGFLKPIAQPISGEDKLDRSTSIIQAAQTTEVGEPLLLSEAELLIGQNQADVLLEKIVERYQQLSKNNEVIIIEGLIPTRKNSYANSINYDVAQALDAEIILVAAPGSDKPVQLKERIEAVASEFGGRDNPNLLGVIINKFNAPVDESGRTRPDLTEIFDSFQHSAQNIAEVEALFAKSPINLLACIKWKSDLIATRAIDVAKHLHAAIINEGDLHTRRIRGVSFCACSIPHMVDYFKAGNLLVTSADRPEVLVAASLAVMNGIEIGAILLTGGYKIDHNVAKLCQQAFETGLPVFRVEGNTWQTALNLQSVSLEVPVDDKGRIDAIKEYVASQFDAHFVDEVSKVATRVRRLSPAAFRYQLTEYAREAKKRIVLPEGDEPRTIKAAALCAKRGIAECVLLANPVDVQRIAEAQGVVLGKGITIINPEDVSENYVSRLVELRKNKGMTEVVAREQLTDTVVLGTMMLEAGEVDGLVSGAVHTTANTIRPPMQIIKTAPGSSIVSSIFFMLLPDQVLVYGDCAVNPDPTAEQLAEIAIQSAESAKAFGIDPRVAMISYSTGSSGSGADVEKVKEATRIAQEKRPDLIIDGPLQYDAAVMEDVARSKAPNSPVAGKATVFVFPDLNTGNTTYKAVQRSADLVSIGPMLQGMRKPVNDLSRGALVDDIVYTIALTAIQATQS

SEQ ID NO: 1730 - protein, 711 aa, Mannheimia haemolytica PHL213
MSRTIILIPISTGVGLTSVSLGLVHALEQKGSKVGFLKPISQPISGEDTLDRSTTIIRAEQTTEVGEPFMLSEAETLIGQNQTDVLLEKVVERHQKLSKNNEIVIVEGLIPTRKNSYANSINYEMAQALDAEIVLVAAPASDTPAQLKERVEAAASQFGGRNNPNLLGVIINKFNAPVDDSGRTRPDLTEIFDSFQHSNNNVSEVEHLFAKSPIKLLGCISWKAELIATRAIDVAKHLGASIINEGEIKARRIRGVTFCARNLPNMVDHFKAGSLLVTSADRPEVLVAASLAVMNGIEIGAILLTGGYKIDSSIAKLCQQAFETGVPVFRIEGNTWQTALSLQSFSLEVPVDDKERIAAIKEYMASKFNVGFIDEVSKAATRARRLSPAAFRYQLTEYARQAKKRIVLPEGDEPRTVKAAALCAERGIAECVLLANPTDVQRVAEAQGVVLGKGVTIIDPASIRENYVDRLVELRKAKGMTEVVAREQLLDTVVLGTMMLEANEVDGLVSGAVHTTANTIRPPMQIIKTAPGSSIVSSIFFMLLPDQVLVYGDCAVNPDPTAEQLAEIAIQSAESAKAFGIDPRVAMISYSTGTSGSGADVEKVKEATRIAQEKRPDLIIDGPLQYDAAIMEDVARSKAPNSPVAGKATVFVFPDLNTGNTTYKAVQRSADLVSIGPMLQGMRKPVNDLSRGALVDDIVYTIALTAIQATQ

SEQ ID NO: 1731 - protein, 711 aa, Haemophilus parasuis SH0165
MSRTIILIPISTGVGLTSVSLGLVHSLEQKGAKVGFLKPIAQPISGEDTLDRSTTIIRLSQSTETGTPFMLSEAETLIAKNQTDVLLEKVVERHQKLTKNSDIVIVEGLIPTRKNSYANSINYEIAQALDAEIVLVAAPAADKPAQLKERIDAAASLFGGRHNPNLLGVVINKFNAPVDESGRTRPDLTEIFDSFQHSSNNILEMENLFKAGPIKLLACISWKSDLIATRAIDLVKHLGAAIINEGEVHKRRIRSVTFCARSLPHMVDHFKAGSLLVASADRPDVIVAASLAAMNGVEIGALLLTGGYKIDTQIAKLCQQAFETGLPIFRIEGNTWQTALSLQSLSLEVPVDDKERIDAIKQYVSEQFDADFIEGISKGAVRARRLSPAAFRYQLTELAREAKKRIVLPEGDEPRTVKAAALCAERGIAECVLLAPPADVQRVAEAQGVTLGKGITIIDPAEVRENYVARLVELRKNKGMTEVVAREQLLDTVVLGTMMLEANEVDGLVSGAVHTTANTIRPPMQIIKTAPGNSIISSVFFMLLPDQVLVYGDCAVNPDPTPEQLAEIAIQSAESAKSFGIDPRVAMISYSTGTSGAGADVEKVAEATRIAKEKRPDLIIDGPLQYDAAIMEDVARSKAPNSPVAGKATVFVFPDLNTGNTTYKAVQRSADLVSIGPMLQGMRKPVNDLSRGALVDDIVYTIALTAIQATQ

SEQ ID NO: 1732 - protein, 714 aa, Pantoea sp. At-9b
MSRTIMLIPTGTSVGLTSVSLGVIRAMERKGVRLSVFKPIAQPRAGGDTPDQTTTIIRKNSAIPAAEPLLMSRVESLLGSNQQDVLMEEIIARYHENTKDAEVVLVEGLVPTRKHQFASALNYEIAKTLNAEIVFVTALGNDSPAQLKERIELTQSSFGGSKNKNITGVIINKLNAPVDEQGRTRPDLSEIFDDSSKASIANIDPKQLFADSPLPVLGCVPWSFDLIATRAIDMSRHLNADIINEGDIHTRRVKSVTFCARSIPHMLEHFRPGSLLVTSADRPDVLVAACLAAMNGVEIGAILLTGGYQIDERIGRLCERAFQTGLPVFMVKTNTWQTSLSLQSFNLEVPADDTQRIEKVQEYVASYINNDWIESLTATSERSRRLSPPAFRYQLTELARKAGKRIVLPEGDEPRTVKAAAICAERGIATCVLLGNPDEIQRVAAAQGVELGKGIEIVDPEVVRENYVPRLVELRKSKGMTEVVAQEQLEDNVVLGTMMLESGEVDGLVSGAVHTTANTIRPPLQLIKTAPNSSLVSSVFFMLLPEQVLVYGDCAINPDPNPEQLAEIAIQSADSAKAFGIDPRVAMISYSTGNSGAGSDVEKVREATRIAQEKRPDLVIDGPLQYDAAIMEDVAKSKAPNSQVAGRATVFIFPDLNTGNTTYKAVQRSADLISIGPMLQGMRKPVNDLSRGALVDDIVYTIALTAIQSQQAEG

SEQ ID NO: 1733 - protein, 709 aa, Erwinia tasmaniensis Et1/99
MLIPTGTSVGLTSVSLGVIRAMERKGVRLSVFKPIAQPRAGGDTPDQTTTIIRKHSDIPAAVPLAMSRVESLLGSNQQDVLMEEIIASYHENTQEAEVVLVEGLVPTRKHQFASALNYEIAKTLNAEIVFVTALGNDSADQLKERIELTQASFGGSKNKSITGVIINKLNAPVDEQGRTRPDLSEIFDDSSKASVANIDPKQLFANSPLPVLGCVPWSFELIATRAIDMCRHLNASVINEGEIATRRVKSVTFCARSLPNMLEHFRPGSLLVTSADRPDVLVAACLAAMNGVEIGAILLTGGYAIDAPIQKLCERAFQTGLPVFRVDTNTWQTSLSLQSFNLEVPSDDTQRIERVQEYVASHIDAEWIESLTATSERSRRLSPPAFRYQLTELARKAGKRIVLPEGDEPRTVKAAAICAERGIATCILLGNPEEIQRVAADQGVELGKGIEIVDPASAREHYVARLVELRKSKGMTEVVAQEQLEDNVMLGTMMLERGEVDGLVSGAVHTTANTIRPPLQLIKTAPNSSLVSSVFFMLLPEQVLVYGDCAINPDPNPEQLAEIAIQSADSALAFGIEPRVAMISYSTGNSGAGSDVEKVREATRIAQEKRPDLVIDGPLQYDAAIMADVAKSKAPNSPVAGRATVFIFPDLNTGNTTYKAVQRSADLISIGPMLQGMRKPVNDLSRGALVDDIVYTIALTAIQSKQAEG

SEQ ID NO: 1734 - protein, 714 aa, Sodalis glossinidius str. 'morsitans'
MSRTIMLIPTGTSVGLTSVSLGVIRAMERKGVSLSVFKPIAQPRSGEDTLDATTRIIRANSTIPSAEPLAMSYVESLLGSNQQDVLMEEIIARYHANTQEAEVVLVEGLVPTRKHQFATALNYEIARTLNAEIVFVLSLGNDSPDQLKERIELVRSSFGGSKNKNITGVIVNKLNAPVDEQGRTRPDLSEIFDDSSKASVANVDPSLLFENSPLPVLGCIPWNFDLIATRAIDMARHLGATIIHEGEIQTRRVKSVTFCARSLPNMLEHFRPGSLLVTSADRPDVLVAACLAAMNGVEIGAVLLTGGYDIDPRIQKLCERAFQTGLPMFTVQTNTWQTSLSLQSFSLEVPADDHSRVEKLQNYVAGHIDNAWIESLSASSERPRRLSPPAFRYQLTELARQAGKRIVLPEGDEPRTVKAASICAERCIAHCVLLGNPDEIQRVAAVQGVTLGDGIEIIDPEVAREKYVARLVELRKSKGMTEVVAHEQLEDNVVLGTLMLEQGEVDGLVSGAVHTTANTIRPPLQLIKTAPGSSLVSSVFFMLLPEQVLVYGDCAINPDPTSEQLAEIAIQSADSAAAFGIEPRVAMISYSTGNSGAGSDVEKVREATRLAQEKRQDLVIDGPLQYDAAIMADVALSKAPNSPVAGQATVFIFPDLNTGNTTYKAVQRSADLISIGPMLQGMRKPVNDLSRGALVDDIVYTVALTAIQSKQAEG

SEQ ID NO: 1735 - protein, 713 aa, Dickeya dadantii Ech586
MSRTIMLIPTGTSVGLTSVSLGVIRSMEQKGVRLSVFKPIAQPRSGDSTLDQTTTIVRATSAIPAAEPLAMNYVESMLSSNQQDVLLEEIIARYHENTKDAEVVLVEGLVPTRKHQFANALNYEIAKTLNAEIVFVLALGNDSPAQLKERIDIARSSFGGSKNKNITGVIINKLNAPVDEQGRTRPDLSEIFDDSTKASVANIDPKLLFANSPLPILGCVPWSFDLIATRAIDMANHLNARVINTGDIQTRRVKSVTFCARSIPHMLEHFRPGSLLVTSADRPDVLVAACLAAMNGVEIGALLLTGGYEIDPAISKLCERAFQTGLPVFMVKTNTWQTSLNLQSFNLELPPDDHERVEKVQEYVARHIDAQWIDSLTATSERSRRLSPPAFRYQLTELARQAGKRIVLPEGDEPRTVKAASICAERGIAQCVLLGNPDEIQRVAAAQGVELGKGIEIIDPVEARERYVPRLVELRKSKGMTEVVAREQLEDNVVLGTLMLEQGEVDGLVSGAVHTTANTIRPPLQLIKTAPGSSLVSSVFFMLLPEQVLVYGDCAINPDPTAEQLAEIAIQSADSAAAFGIDPRVAMISYSTGNSGAGSDVDKVREATRLAQEKRPDLVIDGPLQYDAAIMADVAQSKAPNSPVAGKATVFVFPDLNTGNTTYKAVQRSADLISIGPMLQGMRKPVNDLSRGALVDDIVYTVALTAIQATQIA

SEQ ID NO: 1736 - protein, 712 aa, Pectobacterium wasabiae WPP163
MSRIIMLIPTGTSVGLTSVSLGVIRSMEQKGVRLSVFKPIAQPRSGDNTPDQTTTIIRANSAINAAEPLAMSRVEALLSSNQQDVLMEEIIARYHETTKDAEVVLVEGLVPTRKHQFANALNYEIAKTLNAEIVFVLALGNDSPAQLKDRIELARSSFGGSKNKNITGVIINKLNAPVDDQGRTRPDLSEIFDDSTKASVANIDPKQLFANSPLPVLGCIPWSFDLIATRAIDMAKHLSARIVNEGDIQTRRVKSVTFCARSIPHMLEHFRPGSLLVTSADRPDVLVAACLAAMNGVEIGALLLTGGYEMDPSIAKLCERAFQTGLPVFMVDTNTWQTSLSLQSFNLEVPADDRQRVEKVQEYVARHIDTQWIDSLSAESERSRRLSPPAFRYQLTELARKAGKRIVLPEGDEPRTVKAAAICAERGIAHCVLIGNPEEIQRVAAAQGVELGKGIEIVDPIVVRERYVARLVELRKNKGMTEVVAREQLEDNVVLGTLMLEQGEVDGLVSGAVHTTANTIRPPLQLIKTAPGSSLVSSVFFMLLPEQVLVYGDCAINPDPTAEQLAEIAIQSADSATAFGIDPRVAMISYSTGNSGAGSDVEKVREATRLAQEKRPDLVIDGPLQYDAAIMADVAQSKAPNSPVAGKATVFIFPDLNTGNTTYKAVQRSADLISIGPMLQGMRKPVNDLSRGALVDDIVYTVALTAIQATQL

SEQ ID NO: 1737 - protein, 713 aa, Dickeya dadantii Ech703
MSRTIMLIPTGTSVGLTSVSLGVIRSMEQKGVRLSVFKPVAQPRAGENALDQTTTIIRANSAINVVEPLQVSYVESMLSSNQQDVLLEEIIARYHENTKDADVVLVEGLVPTRKHQFANALNYEIAKTLNAEIVFVMALGNDSPDQLKERIELARSSFGGASNKNITGVIINKLNAPVDEQGRTRPDLSEIFDDSSKASVKNVDPKHLFANTPLPVLGCIPWSFDLIATRAIDMAKHLNAKIVNTGDIETRRVKSVTFCARSIPHMLEHFRPGSLLVTSADRPDVLVAACLAAMNGVEIGALLLTGGYTMEASIAKLCERAFQTGLPVFMVETNTWQTSLNLQSFNLELPADDRERVEKVQEYVARHIDSQWIDSLSAASEGSRRLSPPAFRYQLTELARKAGKRIVLPEGDEPRTVKAAAICAERGIAQCVLLGNPEEIRRVAAVQGVELGKGIEIVDPAVVRERYVPRLVELRKSKGMTEVVAREQLEDNVVLGTLMLEQNEVDGLVSGAVHTTANTIRPPLQLIKTAPGSSLVSSVFFMLLPEQVLVYGDCAINPDPTAEQLAEIAIQSADSATAFGVEPRVAMISYSTGNSGTGSDVDKVREATRIAKEKRPDLVIDGPLQYDAAIMADVAKSKAPNSPVAGQATVFVFPDLNTGNTTYKAVQRSANLISIGPMLQGMRKPVNDLSRGALVDDIVYTVALTAIQSTQIA

SEQ ID NO: 1738 - protein, 717 aa, Yersinia pestis KIM
MSRTIMLIPTGTSVGLTSVSLGVIRSMEQKGVSLSVFKPIAQPRAGNDAPDQTTTIIRANSSITAAEPLNMNYVETLLSSNQQDVLMEEIVARYHENTKDAEVVLVEGLVPTRKHQFANALNYEIAKTLNAEIVFVIALGNDSPDQLKERIELARSSFGGSKNKNITGVIINKLNAPVDEQGRTRPDLSEIFDDSTKASVANIDPSQLFANSPIPVLGCVPWSFELIATRAIDMAKHLNARIINEGDIKTRRVKSVTFCARSIPHMLEHFRPGSLLVTSADRPDVLVSACLAAMNGVEIGAILLTGGYAIDDRINNLCERAFQTGLPVFMVDTNTWQTSLSLQSFNLEVPADDHERVEKLQNYVASHISSEWIDSLTAASERPRRLSPPAFRYELTELARKAGKRIVLPEGDEPRTIKAASICAERGIATCVLLGNPEEIQRVATSQGVELGKGVEIIDPVAVREQYVPRLVELRKSKGMTEVVAREQLEDNVVLGTLMLEKGEVDGLVSGAVHTTANTIRPPLQLIKTAPGSSLVSSVFFMLLPDQVLVYGDCAINPDPTAEQLSEIAIQSADSAAAFGIEPRVAMISYSTGNSGAGSDVEKVREATRLAQEKRPDLIIDGPLQYDAAIMADVAKSKAPNSPVAGRATVFIFPDLNTGNTTYKAVQRSADLISIGPMLQGMRKPVNDLSRGALVDDIVYTVALTAIQSAQADSAAS

SEQ ID NO: 1739 - protein, 729 aa, Serratia proteamaculans 568
MLNREEDYSVSRTIMLIPTGTSVGLTSVSLGVIRSMEQKGVSLSVFKPIAQPRTGGDSLDQTTTIIRSSNSTITAAEPLRMSYVEGLLSSNQQDVLMEEIVARYHENTKDAEVVLIEGLVPTRKHQFANALNYEIAKTLNAEIVFVLALGNDSPAQLKERIELARSSFGGSKNKNITGVIINKLNAPVDEQGRTRPDLSEIFDDSTKASVTNVDPAQLFANSPLPVLGCVPWSFDLIATRAIDMARHLKASVVNEGDIMTRRVKSVTFCARSIPHMLEHFRPGSLLVTSADRPDVLVSACLAAMNGVEIGAILLTGGYAIDEPIRKLCERAFQTGLPVFMVETNTWQTSLSLQSFNLEVPADDHQRIEKVQNYVASHINAEWIESLTATSERSRRLSPPAFRYELTELARKAGKRIVLPEGDEPRTVKAAAICAERGIAECVLLGNPEEIQRVAAAQGVELGKGIEIVDPVAVREQYVPRLVELRKSKGMTEVVAREQLEDNVVLGTLMLEKGEVDGLVSGAVHTTANTIRPPLQLIKTAPGSSLVSSVFFMLLPDQVLVYGDCAINPDPTAEQLSEIAIQSADSAAAFGIEPRVAMISYSTGNSGAGSDVEKVREATRLAQEKRPDLIIDGPLQYDAAIMADVAKSKAPNSPVAGQATVFIFPDLNTGNTTYKAVQRSADLVSIGPMLQGMRKPVNDLSRGALVDDIVYTVALTAIQSSQADAAAVKA

SEQ ID NO: 1740 - protein, 712 aa, Edwardsiella ictaluri 93-146
MSRTIMLIPTSTSVGLTSVSLGVIRSMEQKGVRLSVFKPIAQPHTDVDAPDQTTTIIRANSTIPAAEPLRMSHVEALLSSNQQDVLMEEIVARYHENTKDAEVVLVEGLVPTRKHQFANALNYEIAKTLNAEIVFVMAMGSDTVDQVKERIELARSSFGGSKNQNIAGVIINKLNAPVDEQGRTRPDLSEIFDDSGKARVATLDAAQVIANSPLPVLGCIPWSFELIATRAIDMANHLKARVINAGDIQTRRIKSVTFCARSIPHMLEHFRPGSLLVTSADRPDVLIAACLAAMNGVEIGALLLTGGYEVDARVNKLCERAFQTGLPVFMVDTNTWQTSLSLQSFNLEVPADDHQRIEKLQDFVASHIDAQWIESLSAASERSRRLSPPAFRYELTELARKAGKRIVLPEGDEPRTVKAAAICAERGIAQCVLLGNPDEIQRVAAAQGVTLGKSIEIVDPVAVREKYVPRLVELRKNKGMTEVVAREQLEDNVVLGTLMLEQNEVDGLVSGAVHTTANTIRPPLQLIKTAPGSSLVSSVFFMLLPEQVLVYGDCAINPDPTAEQLAEIAIQSADSAAAFGIDPRVAMISYSTGNSGAGSDVEKVREATRLAQEKRPDLVIDGPLQYDAAIMADVAKSKAPNSPVAGKATVFIFPDLNTGNTTYKAVQRSADLVSIGPMLQGMRKPVNDLSRGALVDDIVYTVALTAIQSSQQ

SEQ ID NO: 1741 - protein, 714 aa, Proteus mirabilis HI4320
MSRTIMLVPTDTRVGLTSVSLGVIRSMEQKGVRLSVFKPIAQPRVKGALDQTTAIIRSHSTIQSAEPLNMDYVESLLSSNKKDVLMEEIVARYHENTADAEVVLIEGLVPMRKHPFAQSLNYEIAKTLGAEIVFVTALGNNTAEQLKERIEFARAEFGGVKNQNITGVIVNKLNAPVDDQGRTRPDLSEIFDDSSKAIISNVDLNTIEKNSPLPLLGCIPWNFDLIATRATDMAKHLNATIINKGDIETRRIKSVTFCARSIPHMLEHFRPGSLLVTSADRPDVLVSACLAAMNGVEIGAILLTGGYQIDAPIKQLCERAFETGLPIFMVNSNTWQTSLNLQSFSLEVPADDHERIEKIQNYVAQHINNQWIDSLTANSERPNRLSPPAFRYQLTELARKAKKRIVLPEGDEPRTVKAASICAERGIATCVLLGDPEEIRRVAAAQGVELGTGIELINPKEVREIYVPRLVELRKNKGMTEVVAREQLEDNVVLGTLMLEKGVVDGLVSGAVHTTANTIRPPLQLIKTAPGSSLVSSVFFMLLPEQVYVYGDCAINPDPTAEQLAEIAIQSADSAKAFGIDPRVAMISYSTGNSGAGSDVEKVREATRLAQEKRPDLIIDGPLQYDAAVMADVAKSKAPNSPVAGKATVFIFPDLNTGNTTYKAVQRSADLVSIGPMLQGMRKPVNDLSRGALVDDIVYTVALTAIQASQQENA

SEQ ID NO: 1742 - protein, 713 aa, Photorhabdus luminescens subsp. laumondii TTO1
MSRTIMLIPTSTSVGLTSVSLGVIRSMEQKGVSLSVFKPIAQPRCRAAQDQTTTIIRANSSIKTAEPLDMAHVESLLTTNQKDVLMEKIVALYHENTKDAEVILIEGLVPTRKHSFAQSLNYEIAKTLNAEIVFVLALGNDSPEQLKERVELARAEFGGNKNQNITGVIINKLNAPVDDQGRTRPDLSEIFDESSKAIVSNIDPNTLFKNSPLPILGCIPWSFDLIATRAIDMAKHLNARIINEGAIKTRRVKSVTFCARSIPHMLEHFRPGSLLVTSADRPDVLVSACLAAMNGVEIGAILLTGGYAIDEPIKQLCERAFNTGLPVFMVDTNTWQTSLNLQSFSLEVPADDHERIEKLQNYVAHHINKEWIDSLTANSERPHRLSPPAFRYQLTELARKAGKRVVLPEGDEPRTVKAASICADRGIARCVLLGDPEEIRRVAAAQGVELGAGIEIVDPIAVRERYVPRLVELRKNKGMTEVVAREQLEDNVVLGTLMLEQGEVDGLVSGAVHTTANTIRPPLQLIKTAPGSSLVSSVFFMLLPEQVLVYGDCAINPDPTAEQLSEIAIQSADSAKAFGIEPRVAMISYSTGNSGAGSDVEKVREATRLAQEKRPDLIIDGPLQYDAAIMADVAKSKAPNSPVAGQATVFIFPDLNTGNTTYKAVQRSADLVSIGPMLQGMRKPVNDLSRGALVDDIVYTVALTAIQSAQGEA

SEQ ID NO: 1743 - protein, 715 aa, Klebsiella pneumoniae NTUH-K2044
MSRTIMLIPTGTSVGLTSVSLGVIRAMERKGVRLSVFKPIAQPRSGGDAPDQTTTIVRASSSTTTAAEPLKMSHVESLLSSNQKDVLMEEIIANYHANTQDAEVVLVEGLVPTRKHQFAQALNFEIAKTLNAEIVFVMSQGTDTPEQLNERIELTRNSFGGAKNTSITGVIVNKLNAPVDDQGRTRPDLSEIFDDSSKAKIVKIDPAQLQKGSTLPVLGAVPWSFDLIATRAIDMAHHLNATIINEGDINTRRVKSVTFCARSIPHMLEHFRPGSLLVTSADRPDVLVAACLAAMNGVEIGAILLTGGYEMDARISKLCERAFATGLPVFMVNTNTWQTSLSLQSFNLEVPVDDHERIEKVQEYVANYINADWIESLTATSERSRRLSPPAFRYQLTELARKAGKRVVLPEGDEPRTVKAAAICAERGIATCVLLGNPDEINRVAAAQGVELGAGIEIVDPEVVRESYVGRLVELRKNKGMTEAVAREQLEDNVVLGTLMLEQDEVDGLVSGAVHTTANTIRPPLQLIKTAPGSSLVSSVFFMLLPEQVYVYGDCAINPDPTAEQLAEIAIQSAESAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQK

SEQ ID NO: 1744 - protein, 713 aa, Enterobacter sp. 638
MSRIIMLIPTGTSVGLTSVSLGVIRAMERKGVRLSVFKPIAQPRAGGDAPDQTTAIVRANSNLPAAEPLKMSHVESLLSSNQKDVLMEEIIANYHANTQNAEVVLVEGLVPTRKHQFAQSLNYEIAKTLNAEIVFVMSQGTDTQEQLKERIELTRSSFGGAKNANITGVIVNKLNAPVDEQGRTRPDLSEIFDDSSKATVVKVDPAQLSESSPLPILGAVPWSFDLIATRAIDMARHLNATVVNEGDIQTRRVKSVTFCARSIPHMLEHFRAGSLLVTSADRPDVLVAACLAAMNGVEIGAILLTGAYEMDARVSKLCERAFATGLPVFMVNTNTWQTSLSLQSFNLEVPVDDHERIEKVQEYVASFINAEWIESLTATSERSRRLSPPAFRYQLTELARKAGKRVVLPEGDEPRTVKAAAICAERGIATCVLLGNPDEITRIAASQGVELGSGIEIVDPEVVRESYVARLVELRKSKGMTEAVAREQLEDNVVLGTLMLEQDEVDGLVSGAVHTTANTIRPPLQLIKTAPGSSLVSSVFFMLLPEQVYVYGDCAINPDPTAEQLAEIAIQSADSAIAFGIEPRVAMLSYSTGTSGAGSDVEKVREATRLAQEKRPDLIIDGPLQYDAAVMADVAKSKAPNSPVAGRATVFIFPDLNTGNTTYKAVQRSADLISIGPMLQGMRKPVNDLSRGALVDDIVYTIALTAIQSSQQQ

SEQ ID NO: 1745 - protein, 712 aa, Cronobacter turicensis
MSRIIMLIPTGTSVGLTSVSLGVIRAMERKGVRLSVFKPIAQPRTGGDTPDQTTTIVRANTNLPAAEPLRMSHVESLLSSNQKDVLMEEIIARFHENTKDAEVVLVEGLVPTRKHQFAQSLNYEIAKTLNAEIVFVMSQGTDTPEQLKERIELTRSSFGGSKNANITGVIVNKLNAPVDEQGRTRPDLSEIFDDSTKAKIINIDAQHLQAISPLPVLGAVPWSFDLIATRAIDMARHLNATIVNEGDIKTRRVKSVTFCARSIPHMLEHFRPGSLLVTSADRPDVLVAACLAAMNGVEIGAILLTGGYEMDERINKLCERAFATGLPVFMVNTNTWQTSLSLQSFNLEVPADDHERIEKVQEYVASHVSAEWIDSLTATSERSRRLSPPAFRYQLTELARKAGKRVVLPEGDEPRTVKAAAICAERGIATCVLLGNPDEISRVAAAQGVELGTGIEIVDPEVVRESYVARLVELRKSKGMTEAVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGNSGAGSDVEKVREATKLAQEKRPDLVIDGPLQYDAAVMADVAKSKAPNSPVAGRATVFIFPDLNTGNTTYKAVQRSADLISIGPMLQGMRKPVNDLSRGALVDDIVYTIALTAIQASQQ

SEQ ID NO: 1746 - protein, 713 aa, Escherichia coli
MSRIIMLIPTGTSVGLTSVAWRDPCNGTQRRSSERFQTYRSAAYRWRCADQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPANVQESSPLPVLGAVPWSFDLIATRAIDMARHLNATIINEGDINTRRVKSVTFCARQHSAHAGALRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 1747 - protein, 709 aa, Candidatus Hamiltonella defensa 5AT (Acyrthosiphon pisum)
MLIPIGTGIGLSSVSLGVIRSMEQKGIRLTLFKPISQSSSNKPDKTTAIIRAHSNLNVGKSLNLDYVESLLRTSQQNVLMEEILAHYHESTLDNEVVLIEGLVSIRQHQFVNMLNEQIARTLNAKIIFVMAMGNDSPVQLRERIELARSNFGGSKNKNIVGVIINKLNAPMDEQGRTRPDLSDICDGSRKTNLKNIDIEHLQNHLPLPLLACIPWHADLIAIRATDIAKHLGAQVINEGDIQTRRIRSFNFCARSLPNMLQYFRAGALLVTSADRSDVLVAACLAAMNGVEIGAILLTGGYIIDPSVNQLCQQAFQTGLPVFKVETNTWQTSLNLQSFSLEIPVDDHERIEKVQNYVADHISNQWICSLTAFSERTHRLSPPAFRYELTERARKANKRIVLPEGDEPRTIKAAAFCAERGIARCVLLGNPEEIHRIAAAQGVELGQEIEIIDPVTTRENYVARLVELRKNKGMTEVVAREQLQDNVVLGTLMLERDEVDGLVSGAVHTTAHTIRPALQLIKTAPGNSLVSSVFFMLLPDQVLVYGDCAINPDPTAEQLAEIAIQSADSAAAFGIEPRVAMISYSTGNSGTGSDVEKVREATMMAQKKRPDLMIDGPLQYDAAIMADVAQSKAPHSPVAGQATVFIFPDLNTGNTTYKAVQRSADLVSIGPMLQGMRKPLNDLSRGALVEDIIYTIALTAIQAVSIKNGT

SEQ ID NO: 1748 - protein, 714 aa, Pectobacterium carotovorum subsp. brasiliensis PBR1692
MPRTIMLIPTGTGVGLTSISLGLIRAIERKGVRLSIFKPVAQPRDSNDITDLTTAIVRTSSRLPVAEPLTIAHTESLLSQQKKEILLETIVARYHENIRHADIVLVEGLVPTRKHPFAASLNMEIANTLNAEVILVLSQGSDNADELKARIELARSSLKPNKGTSIIGAIVNKLNAPVDEQGRARPDLSRIFDDATGANVVSLDIKRLKAMSPLPLLGAVPWNFDLISTRVSDIVSHLQAAAIHTGDRQTRRIKSIVFCARSVPHMLQYFQPGALLVTSADRPEVIIAACLAAMNGVEIGALLLTGGEPIPSSIHTLCERAFATGLPVYLVQSNTWQTSLDLQSYQPTVPVDDYERIEQVCDYMANYIDPVWIDTLSAATERTHRLSPPAFRYQLTELARRAGKRIVLPEGDEPRTIKAAAICAERGIAHCVLLGDPENILHIAASQGVSLGDGITIIDPHVVRERYVPRLVELRKNKGMTDIVAREQLEDNVVLGTLMLEQDEVDGLVSGAVHTTANTIRPPLQLIKTRPESALVSSIFFMLLPEQVLVYGDCAINPDPTAEQLAEIAIQSADSAALFGIEPRVAMISYSTGNSGSGNDVEKVREATRIAQARRPDMIIDGPLQYDAAIMADVARAKAPDSKVAGKATVFIFPDLNTGNTTYKAVQRSADLTSIGPMLQGMRKPVNDLSRGALVDDIVYTIALTAIQGAQHNP

SEQ ID NO: 1749 - protein, 715 aa, Photobacterium sp. SKA34
MSRTIMLVPVGAGVGLTSVSLGVLRAMERKGVRVSFFKPIAQPRKGGDQPDLTTTIISANSDMKIAESFSMASAEELIRNDKTDVLLEDIVARFKAATADADVTLIEGLVATRKHPFANQINFEIAKTLDAEIVFVVSPGTDNPAQLKERIEVACSNFGGIKNKQISGVIVNKLNAPVDAEGRTRPDLSEIFDDAEGTVPSNVEIMQVFNSSPIRVLGCAPWSAELIATRATDIAQHLNAEIINAGDIETRRIKSITFCARSIPNMVEHFRPGSLLVTSADRPDVIVAACLAAMNGVELGALLLTGGYDLPKPVMDLCERAFSTGLPVMTAQGNTWQTSLNLQSFTLEVPADDKERVELVNEYMASHIDGNWIESLTEGSNRERRLSPPAFRYQLTELARKAAKRIVLPEGDEPRTVKAAAICAERGIAECVLLGNPDEIRRVAEQQGVVLGTGVTIINSDEVRENYVARLVELRGAKGMTDVVAREKLQDSVFLGTMMLENNEVDGLVSGAVHTTANTIVPPFQIIKTAPDASIVSSVFFMLLPDQVLVYGDCAINPDPTAEQLAEIAIQSADSAKAFGIDPRVAMISYSTGESGKGADVDKVREATKIAQEKRPDLVIDGPLQYDAAIMENVAASKAPNSPVAGKATVFVFPDLNTGNTTYKAVQRSADLVSIGPMLQGMRKPVNDLSRGALVDDIVYTVALTAIQAEQATEK

SEQ ID NO: 1750 - protein, 718 aa, Photobacterium profundum SS9
MSRTIMLIPVGAGVGLTSVSLGVLRAMERKGVRVSFFKPIAQPRSGGEQPDLTTTIIRANSDMEIAEPFTMARAEELLRNDQSDVLLEDIVARFKASTAQSEVALIEGLVPTRKHPFANQINYEIAKTLGAEIVFVIAHGTDNPAQLKERIEVACSNFGGIKNKQISGVIVNKLNAPVDAEGRTRPDLSEIFDDIDGTTIPLNVEVMQVYNSSPIRVLGCAPWSPELIATRSTDIAAHLNAQIINEGDIATRRIKSVTFCARSIPNMVEHFRPGSLLVTSADRPDVIVAACLAAMNGVEIGALLLTGGYELPKPVMDLCERAFATGLPVMTALGNTWQTSLNLQSFSLEVPADDKERVEFVNEYMASHIDGQWIESLTEGSAKERRLSPPAFRYELTELARKAAKRVVLPEGDEPRTVKAAAICAERGIAECVLLGNPEEIKRVAEQQGVTLGAGVTIIDSESVRENYVKRLVELRGAKGMTDVVAREKLKDSVFLGTMMLEAGEVDGLVSGAVHTTANTIVPPFQIIKTAPDASIVSSIFFMLLPDQVLVYGDCAINPDPNAEQLAEIAIQSADSAKAFGIEPRVAMISYSTGTSGKGADVDKVREATRIAQEKRPDLIIDGPLQYDAAIMENVAASKAPNSPVAGKATVFVFPDLNTGNTTYKAVQRSADLVSIGPMLQGMRKPVNDLSRGALVDDIVYTVALTAIQAKQTENATK

SEQ ID NO: 1751 - protein, 719 aa, Grimontia hollisae CIP 101886
MSRTIMLIPIGTGVGLTSVSLGVLRAMEQKGLRVSFFKPIAQPRHGGDQPDLTTTIIEANSDMKVAEPLTMANAEALIRTDQTDVLMEEIIARFKEATAEAEVALIEGLVPTRNHPFANQVNYEIAKTLDAEIVFVTTPGTDNPAQLKERIEVAVSNFGGIKNPNIAGVMINKHGAPVDEQGRTRPDLSDIFDDNNTAKGSNVEVMEIFNSSPIRVLGCVPWSIDLIATRASDLAKHLNAEIINKGDINTRRIKSITFCARSIPNMIEHFRAGSLLVTSADRPDVIVAACLAAMNGLEIGALLLTGGYSIPEQLHSLCERAFAAGLPVFTTAGNTWQTSLNLQSFSLEVPADDKERVEFVQNHVAAHVDGNWIESLSEGSARERRLSPPAFRYQLTELARKAAKRIVLPEGDEPRTVKAAAICAERKIAECVLLGNPDEIRRVAEQQGVTLGAGVEIIDPDTVREKYVARLVELRKNKGMTEVVAREQLEDTVVLGTMMLEANEVDGLVSGAVHTTANTIRPPLQIIKTAPNASLVSSVFFMLLPDQVLVYGDCAINPDPNAEQLAEIAIQSADSAKAFGIEPRVAMISYSTGTSGQGADVEKVREATRIAQQKRPDLMIDGPLQYDAAIMENVAASKAPNSPVAGKATVFVFPDLNTGNTTYKAVQRSADLVSIGPMLQGMRKPVNDLSRGALVDDIVYTVALTAIQAKQAEEAEAAQ

SEQ ID NO: 1752 - protein, 708 aa, Vibrio furnissii CIP 102972
MLIPISTGVGLTSVSMGLLRAMERKGVSVSFYKPIAQPRSGGDQPDLTSTIVGHNSDMKIGEPMSMSSAEALIGGEKMDVLLETVVERYNQINSSEVTLVEGLVPTRKHPFANQVNAEIAKTLGAEIVFVATPGTHNPAQLKERIEVACSNFGGTKNKNISGVIINKLNAPVDEAGRTRPDLSEIFDDSDSAKQANIEVMQIFNSSPIRVLGCVPWNVDLIATRAIDMAKHLNADVVNEGDINTRRIKSITFCARSIPHMIEHFRPGSLLVTSADRPDVIVAASLAAMNGVEIGAVLLTGGYDIPEEIVSLCKPAFETGLPIFKAQGNTWQTSLNLQSFSLEVPADDKERIEFVCDHVASHIEGAWIETLTEGTQGTRRLSPPAFRYQLTEFARRANKRIVLPEGDEPRTVKAAAICAERGIATCVLLGNPDEIRRVAAQQGVELGAGVEIIDADSVRENYVARLVELRGAKGMTEVVAREKLEDSVFLGTMMLEANEVDGLVSGAVHTTANTIVPPFQIIKTAPNASIVSSVFFMLLPDQVLVYGDCAINPDPTAEQLAEIAIQSADSAAAFGIDPRVAMISYSTGTSGKGADVDKVREATRIAQEKRPDLIIDGPLQYDAAIMENVAASKAPNSPVAGKATVFVFPDLNTGNTTYKAVQRSADLVSIGPMLQGMRKPVNDLSRGALVDDIVYTIALTAIQADQEQK

SEQ ID NO: 1753 - protein, 714 aa, Vibrio metschnikovii CIP 69.14
MSRTIMLVPISAGVGLTSVSMGLLRAMERKGVSVSFYKPISQPRSGGDQPDLTSTIIRHSSDIKIAEPMAMSAAEALIGGEKMDVLLETVVERYNQIIVDAEVTLIEGLVPTRKHPFANQVNAEIAKTLGAEIVFVATPGTDNPTQLKERIEVACSNFGGTKNKNISGVVINKLNAPVDDAGRTRPDLSEIFDDADGAKQANLEVMQIFNSSPIRVLGCVPWSIDLIATRAIDMAKHLKAEIVNEGDINSRRIKSITFCARSIPHMIEHFKPGSLLVTSADRPDVIVAAALAAMNGVEIGAVLLTGGYDIPKEIANLCKPAFDTGLPIFKAQGNTWQTSLNLQSFSLEVPADDKERVEFVSEHVASHIDGPWIDSLTEGTQATRRLSPPAFRYQLTEFARRANKRIVLPEGDEPRTVKAAAICAERGIAKCVLLGNPEEIKRVAALQGVELGAGVEIIDAAAVRENYVARLVELRGAKGMTEVVAREKLEDSVFLGTMMLEANEVDGLVSGAVHTTANTIVPPFQIIKTAPNASIVSSVFFMLLPDQVLVYGDCAINPDPTAEQLAEIAIQSADSAAAFGIEPRVAMISYSTGTSGKGADVDKVREATRLAQEKRPDLIIDGPLQYDAAIMENVAASKAPNSPVAGKATVFIFPDLNTGNTTYKAVQRSADLVSIGPMLQGMRKPVNDLSRGALVDDIVYTIALTAIQADQEQK

SEQ ID NO: 1754 - protein, 721 aa, Vibrio sp. AND4
MSRTIMLIPASAGVGLTSVSMGVLRAMERKGVKVSFYKPISQPRSGGDQPDLTSTIVGCNSDMKIGQPLAMSVAENLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNEMKVMEIFNTSPIRVLGCVPWSIDLIATRATDMAKHLNADIINEGEINTRRIKSITFCARSLPNMIAHFRPGSLLVTSADRPDVIVAASLAAMNGVDIGAILLTGGYDIPEEIEGLCKPAFETGLPIFKAQGNTWQTSLNLQSFSIEVPADDKERIEFINEHVAGHIDGNWIESMTEGTQKSRRLSPPAFRYQLTEFARKAGKRIVLPEGDEPRTVKAAAICAERGIAECVLLGNPDEIRRVAEQQGVTLGAGVTIINSDEVRENYVARLVELRGAKGMTEVVAREKLQDSVFLGTMMLENNEVDGLVSGAVHTTANTIVPPFQIIKTAPDASIVSSVFFMLLPDQVLVYGDCAINPDPTAEQLAEIAIQSADSAAAFGIDPRVAMISYSTGESGKGADVDKVREATKIAQEKRPDLVIDGPLQYDAAIMENVAASKAPNSPVAGKATVFVFPDLNTGNTTYKAVQRSADLVSIGPMLQGMRKPVNDLSRGALVDDIVYTVALTAIQADQADQAREKVVN

SEQ ID NO: 1755 - protein, 714 aa, Vibrio vulnificus YJ016
MSRTIMLIPASAGVGLTSVSMGVLRAMERKGVKVSFYKPIAQPRSGGDLPDLTTTIVGANSDMKIGEPLLMSVAENLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNQLEVMQIFNSSPIRVLGCVPWSINLIATRAIDMAKHLKAEVINEGDINTRRIKSITFCARSLPHMIEHFKPGSLLVTSADRPDVIVAASLAAMNGVEIGAVLLTGGYDIPTEIENLCKPAFESGLPIFKAQGNTWQTSLNLQSFSLEVPADDKERIEFINDHVAGHIDGNWIESMTEGTERSRRLSPPAFRYQLTELARKAGKRIVLPEGDEPRTVKAAAICAERGIAECVLLGNPEEIKRVAAQQGVELGAGVKIIDADAIRENYVARLVELRGSKGMTEVVAREKLQDSVFLGTMMLENDEVDGLVSGAVHTTANTIVPPFQIIKTAPNASIVSSVFFMLLPDQVLVYGDCAINPDPTAEQLAEIAIQSADSAAAFGIDPRVAMISYSTGESGKGADVDKVREATKLAQEKRPDLIIDGPLQYDAAIMENVAASKAPNSPVAGKATVFVFPDLNTGNTTYKAVQRSADLVSIGPMLQGMRKPVNDLSRGALVDDIVYTIALTAIQATQDQK

SEQ ID NO: 1756 - protein, 714 aa, Vibrio shilonii AK1
MSRTIMLVPTSAGVGLTSVSMGVLRAMERKGVNVAFYKPIAQPRHGGDQPDLTSTIVGNSSDMKVGQPLPMSDVENLYGSEKVDVLLETIVERYNQVSKDAEVTLIEGLVPTRKHPFANAVNAEIAKTLGAEIVFVATPGTDNPSQLKERIEVACTNYGGTKNKNISGVIINKLNAPVDEAGRTRPDLSEIFDDADTAQQANLEVMQIFNTSPIRVLGCVPWKIDLIATRAIDMAQHLNAEVINAGDIEKRRIKSITFCARSLPNMIEHFKPGSLLVTSADRPDVIVAAALAAMNGVEIGAILLTGGYDVPVEIADLIKPALDTGLPIFKAQGNTWQTSLNLQSFSLEVPADDKERIEFVNEHVAGHIDGPWIDSLLEGTIGTRKLSPPAFRYQLTELARKAGKRIVLPEGDEPRTVKAAAICAERGIAECVLLGNPDEIKRVAAQQGVELGAGVTIIDSDAVRENYVARLVELRGAKGMTEVVAREKLQDSVYLGTMMLEANEVDGLVSGAVHTTANTIVPPFQIIKTAPGTSIVSSIFFMLLPDQVLVYGDCAINPDPTAEQLAEIAIQSADSAAAFGIDPRVAMISYSTGESGKGADVDKVREATKLAKEKRPDLIIDGPLQYDAAIMENVAASKAPNSPVAGKATVFVFPDLNTGNTTYKAVQRSADLVSIGPMLQGMRKPVNDLSRGALVDDIVYTVALTAIQSGQEQK

SEQ ID NO: 1757 - protein, 734 aa, Vibrio splendidus LGP32
MSFFISNSQRCSSMSRTIMLIPTSAGVGLTSVSMGVLRAMERKGVSVSFYKPIAQPRSGGNQPDLTSTIISANSDIKIGEPIAMTKAEALIGSEKTDELLESVVEQYNKINKDAEVTLIEGLVPTRKHPFANQVNAEIAKTLGAEIVFVATPGTDNPTQLKERIEVACSNFGGTKNKNIKGVIINKLNAPVDEAGRTRPDLSEIFDDADSAQQANLEVMQIFNSSPIRVLGCVPWSIDLIATRAVDMAKHLNAEIVNEGEISTRRIKSITFCARSLPHMIEHFKPGSLLVTSADRPDVIVAAALAAKNGVEIGAILLTGGYDIPESIANLCAPAFASGLPIFKAQGNTWQTSLNLQSFNLEVPADDKERIEFVNDHVASHIDGPWIDSLSEGTQGIRRLSPPAFRYQLTEFARKAAKRIVLPEGDEPRTVKAAAICAERGIATCVLLGNPEEIRRVAAQQGVELGAGVEIIDSASVRENYVARLVELRGAKGMTEVVAREKLEDSVFLGTMMLEAGEVDGLVSGAVHTTANTIVPPFQIIKTAPDASIVSSIFFMLLPDQVLVYGDCAINPDPTAEQLAEIAIQSADSAAAFGIDPRVAMISYSTGESGKGADVDKVREATKLAQAKRPDLVIDGPLQYDAAIMENVAASKAPNSPVAGKATVFVFPDLNTGNTTYKAVQRSADLVSIGPMLQGMRKPVNDLSRGALVDDIVYTVALTAIQADQAAQAEEKVIN

SEQ ID NO: 1758 - protein, 723 aa, Aliivibrio salmonicida LFI1238
MSRTIMLVPISAGVGLTSASLGVLRSMERKGVSVSFYKPISQPRHGGDQPDLTTSIVTSSSDIKAAEPTTVSRAEELLRNDQTDVLLEEIVARYKSISEDTDVTLIEGLVPTRKHPFANQLNGEIAKTLGAEIVFVATPGTDNPSQLKERIEVACSNFGGTKNKQIAGVIINKLNAPVDEAGRTRPDLSEIFDDADATTKTNLEVMQIFNSSPIRVLGCVPWKIDLIATRAIDMAKHLNAEIINEGEIATRRIKSITFCARSLPHMIEHFKPGSLLVTSADRPDVIVAACLAAMNGVEIGAILLTGGYEIPQSIADLCKPALDAGLPIFTAQGNTWQTSLNLQSFSLEVPADDKERIEFVNEHVASHIDGPWIDSLSEGTEGIRRLSPPAFRYQLTEFARKAAKRIVLPEGDEPRTVKAAAICSERGIATCVLLGNPEEIRRVAAQQGVELGAGVEIIDSESVREKYVARLVELRGAKGMTEVVAREKLKDSVFLGTMMLEAGEVDGLVSGAVHTTANTIVPPFQIIKTAPDASIVSSIFFMLLPDQVLVYGDCAINPDPTAEQLAEIAIQSADSAAAFGIDPRVAMISYSTGESGKGADVDKVREATKLAQAKRPDLIIDGPLQYDAAIMENVAASKAPNSPVAGKATVFVFPDLNTGNTTYKAVQRSADLVSIGPMLQGMRKPVNDLSRGALVDDIVYTVALTAIQASQAEEAEKAEKVIN

SEQ ID NO: 1759 - protein, 714 aa, Vibrio cholerae bv. albensis VL426
MSRTIMLIPISAGVGLTSVSMGLLRAMERKGVSVSFYKPIAQPRTGDDQPDLTSTVMSRNSDIKIGQPMSMSAAETLIGSEKMDVLLETVVERYNQINKDAEVTLIEGLVPTRKHPFANQVNAEIANTLGAEIVFVATPGTDNPTQLKERIEVACSNFGGTKNKSISGVIINKLNAPVDEAGRTRPDLSEIFDDADHAKQANLEVMQIFNTSPIRVLGCVPWSIDLIATRAIDMAKHLKAEIINQGDINTRRIKSITFCARSIPNMIEHFKPGSLLVTSADRPDVIVAAALAAMNGVEIGAVLLTGGYDIPRELVSLCKPAFDTGLPIFKAQGNTWQTSLNLQSFSLEVPADDKERIEFISEHVASHIDGPWVDSLTEGAQASRRLSPPAFRYQLTELARSANKRIVLPEGDEPRTVKAAAICAERGIAQCVLLGNPEEIKRVAAQQGVELGSGIEIIDPKVAQEKYVARLVELRKSKGMTEVVAREQLEDTAVLGTMMLERNEVDGLVSGAVHTTANTIRPPLQIIKTAPNASLVSSIFFMLLPDQVLVYGDCAINPDPNAEQLAEIAIQSADSAAAFGIEPRVAMISYSTGTSGQGADVDKVREATRIAKEKRPDLVIDGPLQYDAAIMENVAASKAPNSPVAGKATVFVFPDLNTGNTTYKAVQRSADLVSIGPMLQGMRKPVNDLSRGALVDDIVYTIALTAIQAGQEQK

SEQ ID NO: 1760 - protein, 717 aa, Aeromonas salmonicida subsp. salmonicida A449
MARTIMLIPVGTGVGVTSVSLGVVRAMERHGVNVSFFKPVAQPRPGETGTERSTAVIRAAANINPPEPFALSYAENMITSSNTDILLEEIVARFEEHVKASGAEVLVIEGMVPTDKQPFANKLNYDVAKALDADMVFVTHPGNDSSQKLKERIELACSNFGGVNNPRIVGCVINKVGAPVDEHGVTRPDLTEMFEAHHHASEAAHNLEVLQVFGKSPLRILGCIPWNTQLIAPRAKDLAKHLAAKILHKGELDSRRLQTVTFCARSIHNMVEHFRPGSLLVTSGDRSDVIVSACLSAMNGVKLGALLLTGNYHPEPQVMALCQQAMATGLPIMITGTNTWQTAVSLQNFNVDIPEDDRERIELVQDYVAGHIDKHWIESLSAKSTRSRRLSPPAFRYQLTELARQANKRVVLPEGEEPRTIKAASICAERGIARPVLLGNPEEIRRVAEQQGVVLTDSVEIIDPLEVRERYVPRLVELRKNKGMTEVVAREQLEDNVVLGTMMLERGEVDGLVSGAVHTTANTIRPPMQIIKTAPGSSLISSIFFMLLPDQVLVYGDCAINPDPTAEQLAEIAIQSADSAAAFGIEPRVAMISYSTGTSGAGADVEKVREATELAKAKRPDLIIDGPLQYDAAIMENVAKSKAPNSPVAGKATVFVFPDLNTGNTTYKAVQRSADLVSIGPMLQGMRKPVNDLSRGALVDDIVYTIALTGIQAAQAE

SEQ ID NO: 1761 - protein, 718 aa, Tolumonas auensis DSM 9187
MARTIMLIPIGTGVGVTSVSLGMVRAMERHGVNVSFFKPVAQPRPGQSGPETSTAVIRAGSNITPPEPLSLQYAENMITSNNSAVLLEEIVALYQRHIQESGAEVVVIEGLVPVEKQPFANKLNQDIATALDAEIVLVTHPGNYSSQKLKESIELACSNFGGTGNKRIVGCIINKVGAPVDEHGITRPDLTEMFEAHHTGESGSNQLEILQFFGKSPLQILGCIPWNAQLIAPRAIDLARHLNARIINEGEIYTRRLNIVTFCARSIHNMVQHFKPGSLLVTSGDRSDVIVSACLSAMNGVKLGALLLTGGYHPEPQVMALCQQAMQTGLPILMINTNTWQTAVSLQNFNVEIPIDDNARIELVQDYVAGHIDKHWLESLTSESSLPRRLSPPAFRYQLTELARAANKRIVLPEGDEPRTIRAAAICADRGIARPVLLGNPDEIRRVAEQQGVVLSDRVEIIDPVEARERYVPRLVELRKSKGITEVVAREQLEDNVVLGTLMLERNEVDGLVSGAVHTTANTIRPPLQIIKTAPGSSLVSSIFFMLLPDQVLVYGDCAINPDPNAEQLAEIAIQSADSAAAFGIEPRVAMISYSTGTSGTGADVDKVREATRIAKEKRPDLIIDGPLQYDAAVMADVARSKAPNSPVAGKATVFIFPDLNTGNTTYKAVQRSADLVSIGPMLQGMRKPVNDLSRGALVDDIVYTIALTGIQATQTPA

SEQ ID NO: 1762 - protein, 720 aa, Psychromonas sp. CNPT3
MSRTIMLIPIGSGVGVTSVSLGMVRAMERQGIAVNFFKPIAQPRPGDTGPERSTATLRNASVLCPPEPFAMKYAENMLSSGRKSDLLENIVERFRQGTKDNDVIIVEGLVPTDKHQFANEINYSIAKALNAEMVFVTHPSNDSSQQLKERMEIAVDAFGGKKNKRIAGCIINKVGAPVDEHDKSRPDLSEMFDIPEVNAQTNLEVLQMFSKSPLPILGCIPWSADLIAPRVQDLIQYLDAQVLNKGDAAHRRLHSVTFCARSIPNMLEHFKAGSMLVTSGDRSDVIIAACLAVMNGMKIGCLLLTGDYMPEDEVMKLCERAMETGLPVLLIKSNTWKTAQRLQNFNMEIPVDDIERIEKVQDYIASHIDNHWLSTLTNDSTLSRRLSPPAFRYHLTELARQTRQRIVLPEGTEPRTIQAALICAQRGIATPVLLGDPKEIHRIASLQGIELTDDVEIINPLDVFENYVAPMVELRKAKGLTAVVAREQLQDTVVLGTMMLAENEVAGLVSGAVHTTANTIRPALQLIKTAPGASLVSSVFFMLLPDQVFVYGDCAINPDPTADQLADIAIQSADSAIAFGIEPKVAMISYSTGDSGAGSDVEKVREATKIAQQRRPDLLIDGPLQYDAAVMENVAKSKAPNSKVAGQATVFIFPDLNTGNTTYKAVQRSADLISIGPMLQGMRKPVNDLSRGALVDDIVYTVALTAIQATQSQQRDAAKK

SEQ ID NO: 1763 - protein, 720 aa, Psychromonas ingrahamii 37
MPRTIMLIPIGSGVGVTSVSLGMVRALERQGVAVNFFKPIAQPRSGDVGPERSTATLRNASALNPPEPFAMKYAENLISSSRTSELLENIVERFRQGTKESDVIIVEGLVPTDKHQFANEINYSIAKALGAEMVFVTHPNNDTSQQLKERIEIAVSSFGGKNNQRIAGCIINKVGAPSDESEQYRPDLTEMFEGAHDSLNSNLEVLQMFSKSPLPILGCIPWSSELIAPRVVDLATHLHAKILNKGDLNTRRLQRVTFCARSIPNMLEHFKAGSMLVTSGDRSDVIIAACLAVMNGMKIGCLLLTGDYTPEAEVMKLCARAMESGLPILLINSNTWQTAQRLQNFNMEIPVDDIERIEKVQEYIAGHVDKHWLKTLTGDSSLSRRLSPPAFRYHLTELARKNSQRIVLPEGEEPRTIQAALICAQRGIAKPVLLGNPEEIHRVATQQGIVLTDDVEIINPDDVIEDYVAPMVELRKSKGLTEVVAREQLRDTVVLGTMMLAEGEVSGLVSGALNTTANTIRPALQLIKTAPGANLVSSIFFMLLPDQVLVYGDCAINPDPSAEQLADIAIQSADSAIAFGIDPKVAMISYSTGTSGVGSDVDKVREATKIAQQRRPDLLIDGPLQYDAAVMENVAKSKAPDSPVAGKATVFIFPDLNTGNTTYKAVQRSANLISIGPMLQGMRKPVNDLSRGALVDDIVYTIALTAIQATQAMDKAIANV

SEQ ID NO: 1764 - protein, 713 aa, Shewanella sediminis HAW-EB3
MSRNIMLIPIGTGVGLTSISLGLVRAFEHHGVKVRFFKPIAQQRPHDTGPERSTTILSKSPTVNPLEPFEMAHAESLIRGDQTDTLMEQIIARVTEYADESETLVVEGLVQTRNHPFSSEINYAIAKALDADIIFVATPGNESATALMNRLEIAHNSWGGSKNKRIIGAIVNKIGAPVDNEGRARPDLSEVFDHADIQRPDAASMFQLPGKSSLRILGSVPYNLDLVAPRASDLAKHLSAKLINAGEMNTRRLRKVTFCARSIPNMVTHIKTDSLLVTSGDRSDVIVSACLAAMNGVKVGALLLTGSYEPEPEIMALCEQAFETGLPVFLIDTNTWQTSLNIQRFDHEVPVDDAVRIEEVQEYVASHIDQNWIATVTKNSPREHRLSPPAFRYKLTELAREARKTVVLPEGADPRTIEAASICSDRGIAKCVLLGNREEIERIAVRQGVVLGEGVEIIDPLSARERYVEPMLELRRHKGLTEVVAREQLEDNMVLGTMMLAQSEVDGIVSGAVNTTAHTIRPPLQLIKTAPGSSLVSSIFFMLMPDQVLVYGDCAINPDPNAEQLADIAIQSAESAAAFGIEPRVAMISYSTGSSGTGSDVDKVREATRIAKEKRPDLIIDGPLQYDAAVMPNVAQSKAPNSPVAGQATVFVFPDLNTGNTTYKAVQRSADLISIGPMLQGMRKPVNDLSRGALVDDIVYTIALTAIQASQQK

SEQ ID NO: 1765 - protein, 713 aa, Shewanella woodyi ATCC 51908
MSRNIMLIPIGTGVGLTSISLGLVRAFEHHGVKVRFFKPIAQQRPQDSGPERSTTILSKSPTVNPLEPFDMDHAEGLIRGDKTDVLMEQIIARVTESTDDTETLVVEGLVQTRNHPFSSDINYAIAKSLDADIIFVATPGNESATALMNRLEIAHNKWGGVKNKRIIGAMINKIGAPVDNEGRARPDLSEVFDHADVQRPDAASMFQLPGKSSLRILGSVPYNLDLVAPRASDLAKHLSAKIINAGEMNTRRLRKVTFCARSIPNMVTHIKTDSLLVTSGDRSDVIVSACLAAMNGVKVGALLLTGSYEPEPEIMALCEQAFETGLPVFLIDTNTWQTSLNIQRFDHEVPVDDAVRIEEVQEYVASHIDQNWIETATKNSPREHRLSPPAFRYKLTELARAARKTVVLPEGHDSRTIEAASICAERGIAKCVLLGNREEIERIAAQQGVTLGEGVEIVEPDTARERYIEPMLDLRRHKGLTEVVAREQLGDNMVLGTMMLAQNEVDGIVSGAVNTTANTIRPPLQLIKTAPGSSLVSSIFFMLMPDQVLIYGDCAINPDPNADQLADIAIQSADSAAAFGIEPRVAMISYSTGSSGTGSDVDKVREATRIAKEKRPDLIIDGPLQYDAAVMPNVAQSKAPNSPVAGQATVFVFPDLNTGNTTYKAVQRSADLISIGPMLQGMRKPVNDLSRGALVDDIVYTIALTAIQASQAE

SEQ ID NO: 1766 - protein, 712 aa, Shewanella loihica PV-4
MSRNIMLIPNGTGVGLTSISLGMVRALERHGVKVRFFKPIAQQRPTDKGPERSTTILSKSPTVNPLEPFDMAHAEHLIRTDQTDVLMEQIIARATECADPSETLIVEGLVQTRNHPFSDDINYEIAKALDADIIFVAAPGNETPTALMNRLEIAHNAWGGSKNKRLIGAIINKIGAPVDDEGRARPDLSEVFDHQDVQRPDAASMFQLPGKSKLRILGSVPYNLNLVAPRASDLAKHLSARIINAGEMNTRRLRKVTFCARSIPNMVTHIKTDSLLVTSGDRSDVIVSACLAAMNGVKVGALLLTGSYEPEPEIMALCEQAFETGLPVFLIDTNTWQTSLNIQRFDHEVPVDDAVRIEEVQEYVASHIDQSWVESVTMNSPREHRLSPPAFRYKLTELARAAAKTVVLPEGDEPRTIEAAAICAERGIARCVLIGNPEEIQRIASQQGVTLGEGVEIIEPETARERYVAPMVELRRHKGMTEVVAREQLEDNMVLGTMMLAQGEVDGIVSGAVNTTANTIRPPLQLIKTAPGSSLVSSIFFMLMPDQVLVYGDCAINPDPNAEQLADIAIQSADSAAAFGIEPKVAMISYSTGSSGTGSDVDKVREATRIAKEKRPELVIDGPLQYDAAVMPNVAQSKAPNSPVAGQATVFVFPDLNTGNTTYKAVQRSADLISIGPMLQGMRKPVNDLSRGALVDDIVYTIALTAIQASQN

SEQ ID NO: 1767 - protein, 715 aa, Shewanella halifaxensis HAW-EB4
MSRNIMLIPVGTGVGLTSISLGMVRALERHGVKVRFFKPIAQQRPNDNGPERSTTILSKSPTVNPLEPFEMEHAEKLIRADQTDVLMEQIIARATECADDTETLIVEGLVQTRNHPFSSDVNHAIAKALDADIIFVATPGNESATALMNRLEISHNSWGGSENKRLIGAIVNKIGAPVDDEGRARPDLSEVFDHDEMQRPDAASMFQLPGKSPLRILGSVPYNLDLVAPRASDLAKHLSAKIINAGEMNTRRMRKVTFCARSIPNMVTHIKTDSLLVTSGDRSDVIVSACLASMNGVKVGALLLTGGYEPEPQIMELCEQAFETGLPVFLIDTNTWQTALNIQRFDHEVPVDDAVRIELVQEFVASHIDQNWVESITKNSPREHRLSPPAFRYKLTELARAARKTVVLPEGDEPRTIEAAAICAERGIARCVLLGNREEIERIATQQGVVLGDGVEIIDPETSRSRYVEAMVELRRGKGLTEVVAREQLEDNMVLGTMMLAQGEVDGIVSGAVNTTANTIRPPLQLIKTAPGSNLVSSIFFMLMPDQVYIYGDCAINPDPNAEQLADIAIQSAESAIAFGIEPRVAMISYSTGSSGTGSDVDKVREATRIAKEKRPDLIIDGPLQYDAAVMPNVARSKAPDSPVAGQATVFVFPDLNTGNTTYKAVQRSADLISIGPMLQGMRKPVNDLSRGALVDDIVYTIALTAIQAAQNEKA

SEQ ID NO: 1768 - protein, 717 aa, Shewanella sp. ANA-3
MSRNIMLIPIGTGVGLTSLSLGMVRALERHGVKVQFFKPISQLRPNDNGPERSTTILSKSPTVNPLEPFDMAHAEALIRADQTDVLMEQIIARAAECASNTETLIVEGLVPTRNHPFADDVNYAIAKAMDADVIFIATPGSDTPTGLMNRLEIAYNSWGGKNNKRLIGAVINKIGAPVDDEGRARPDLSEVFDHQGVQRSDASIMFQMPGKSPLRILGSVPYNLDLVAPRASDLAKHLRARILNAGEMNTRRLRKVTFCARSLPNMVNHIKTDSLLVTSGDRSDVIVSACLAAMNGVKIGALLLTGSYEPEPEILKLCEQAFETGLPVFLIDTNTWQTSLNIQRFDHEVPVDDAVRIDLVQEYVASHIDQSWIESVTKNSPREHRLSPPAFRYKLTELARAAHKTVVLPEGDEPRTIKAAAICAERGIARCVLLGKKDEIQRIAAQQDVVLGEGVVIVDPDEVRDRYVEPMLDLRRNKGLTEVVAKEQLEDNMVLGTMMLAQNEVDGIVSGAVNTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLVIDGPLQYDAAVMPNVARSKAPNSPVAGQATVFVFPDLNTGNTTYKAVQRSADLISIGPMLQGMRKPVNDLSRGALVDDIVYTIALTAIQASQNDASKA

SEQ ID NO: 1769 - protein, 712 aa, Shewanella amazonensis SB2B
MSRNIMLVPIGTGVGLTSLSLGMVRALERHGVKVQFFKPISQQRPADSGPERSTTILSKSPTVNPLEPFDMQHAESLIRTDQTDVLMEQIIARASEIAANTETLIIEGLVPTRSHSFSDDVNYAIAKALDADVIFIATPGNDTPNALMNRLEIAYNSWGGAKNKRLIGAVINKIGAPVDDEGRTRPDLSEVFDHQDIQKGDATAMFQLPGKSKLRILGSVPYNLDLVSPRASDLAKHLHARILNAGEMNTRRLRKVTFCARSIPNMLSHFRTDSLLVTSGDRSDVIVAACLAAMNGVKIGALLLTGSYEPEPEVLKLCEQAFETGLPVFMIDTNTWQTSLNIQRFNHEVPVDDAVRIELVQEYVASHIDQSWIESVTENSPREHRLSPPAFRYKLTELARAAKKCIVLPEGDEPRTIKAASICAERGIARCVLLGKKDDILRIAAAQDVVLGEGVEILDPEDIREQYVEPMLNLRRHKGLTEVVAREQLEDNMVLATMMLAEDEVDGIVSGAVNTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLVIDGPLQYDAAVMPNVARSKAPDSPVAGKATVFVFPDLNTGNTTYKAVQRSAELISIGPMLQGMRKPVNDLSRGALVDDIVYTIALTAIQATQQ

SEQ ID NO: 1770 - protein, 715 aa, Shewanella frigidimarina NCIMB 400
MSRNIMLIPIGIGVGLTSLSLGMVRALERKGVKVQFFKPIAQIRSGDTGPERSTTILSTSPTVNPLEPYSMVHAEALIRSEQTDVLLEQIIARAAECASNTEILVVEGLVPTRSHPFADDINYEIAKALDADVIFIATPGNDTPNGLMNRLEIAFNSWGGQKNKRLIGAIINKIGAPVDNEGRTRPDLSEVFDDKNMNAVDSSGMFQLPGKSPLRILGSVPYNLELIAPRASDLAKHLNAKIINAGEMHTRRMRRVTFCARSLPNMVTHIKTNSLLVTSGDRSDVIVSACLAAMNGVKIGALLLTGGYPPEPEIMKLCEQAFETGLPVFLIDSNTWQTSLNIQRFDHEVPVDDAVRVEKVQEYVASHIDQTWIESVTQDSPREHRLSPPAFRYKLTELARAARKTIVLPEGEEPRTVKAASICAERGIARCVLIGNREEILRVASQQDVILGEGIEIIEPESVREKYVEPMLELRRSKGLTEVVAREQLEDNMVLGTMMLAQDEVDGIVSGAIHTTAHTIRPPLQLIKTAPGSSLVSSIFFMLMPDQVLVYGDCAINPDPNPEQLADIAIQSAESAKAFGIEPRVAMISYSTGTSGTGSDVDKVREATRIAKEKRPDLIIDGPLQYDAAVMPNVALSKAPDSPVAGKATVFVFPDLNTGNTTYKAVQRSADLISIGPMLQGMRKPVNDLSRGALVDDIVYTIALTAIQAAQNSAK

SEQ ID NO: 1771 - protein, 726 aa, Shewanella denitrificans OS217
MSRNIMLIPTGTGVGLTSLSLGMVRALERKGVKVQFFKPIAQIRTGDKGPERSTTILSQSPSVNPLEPFSMHHAENLIRAEQTDVLMEQIIARAAECASNTEIIVIEGLVPTRSHPFSDDINYEIAKALDADVVFIATPGNDTANGLMNRLEIAYNSWGGNKNKRLIGAIINKIGAPVDEEGRARPDLSEVFDHQGVKHSDTAGMFQLPGKSPLRILGSVPYNLDLVSPRASDLAKHLNARIINAGEMDTRRMRKVTFCARSIPNMVTHIKTNSLLVTSGDRSDVIVSACLAAMNGVKVGALLLTGGYQPEPEIMKLCEQAFETGLPVFLIDTNTWQTSLNIQRFDHEVPVDDAVRIEKVQEFVASHIDQNWIESVTQDSPREHRLSPPAFRYKLTELARAAKKTIVLPEGEEPRTIKAASICAERGIAKCVLLGNKEEIERLASLQDLILGDGIEIIDPINVRDNYVAPMLQLRKGKGLTEVVAKEQLEDNMVLGTMMLAQDEVDGIVSGAINTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLIIDGPLQYDAAVMPNVARSKAPDSPVAGKATVFVFPDLNTGNTTYKAVQRSADLISIGPMLQGMRKPVNDLSRGALVDDIVYTIALTAIQAAQNEAKLVLDVKPLSKN

SEQ ID NO: 1772 - protein, 712 aa, Shewanella sediminis HAW-EB3
MSRNIILIPIGTSVGLTSVSLGLVRAFEHHGVKIRFFKPIAQQRSHDKGSERSTTILSQSPTVNPLEPFSMKYAEDMIRTNKTDTLMEQIIARVTEHIETSDTLIVEGLVQTRNHPFSGDINYAIAKALDADIIFVATPGNETTTALMHRLEIAHNTWGGAKNKRLIGAIINKVGAPIDDEGHIQADMSEVLNNRRSQGLNTASMFKPIGKSPVRVLGIVPYNLNLVAPRASDLAKHLNAKIINAGEMSTRRLRKVTFCARSIPNMVSHLQTDSLLVTSGDRSDAIVAACLATMNGVNIGALLLTGNYDPEPEVMTLCEQALETGLPVFLANTNTWQTSLNIQRFNYEVPVDDAVRIEECQEYVASHIDPSWIKSVTENSPREHHLSPPAFRYKLTELAKAACKTVVLPEGNEPRTIEAASICAQRGIAKCVLLGNTEEIERIAKQQGVTLGEGVTIIEPETARARYIEPMLELRSHKGLTEVVAKEQLEDNMVLGTMMVAQNQVDGIVSGAVNTTANTILPPLQLIKTAPGASLVSSIFFMLMPDQVLIYGDCAINPDPNAEQLADIAIQSAESAAAFGIEPRVAMISYSTGSSGSGSDVDKVREATRIAKEKRPDLIIDGPLQYDAAVMPNVAQSKAPNSPVAGQATVFVFPDLNTGNTTYKAVQRSAELISIGPMLQGMRKPVNDLSRGALVDDIVYTIALTAIQASQG

SEQ ID NO: 1773 - protein, 716 aa, Shewanella halifaxensis HAW-EB4
MPRKIMLVPIGSGVGLTSISLGMVRAFEHQGVKVRFFKPISQIRVGDKGPERSSTILGNSPRVNPIEPFEMAWAQQLIREGKSDVLMEQIIARVAKSIDSTETLIIEGLVQTRSQPFANDVNYAIAKALDVDVIFITSPGNEQPDDVKNRIEIVCNRWGGAKNQRIAGVIVNRIGAPVDDEGRIRLDLSEVFDSNGKLVFDNKKLMRSLSTASVPVLGAIPYNPDLVAPRALDLAKHLNAKIINSGEMELRRLRHVTLCARTIPNMVSHFKTDALLVTSGDRSDVITAACLAAMNGVKIGALLLTGGVDPAPEILELCAQALATGMPIFLVNSNTWQTALNIQRFNHEVPVDDIVRIEEGKEFVAKLIDKQWVKSVTKDSSREHRLSPPAFRFQLTEMARAAGKTVVLPEGNEPRTIEAATICAQRGIAKCILLGDKEEITRIAAQKGLTLGDGVVIVEPHAVREQYIEPMLALRRHKGLTEVVAKEQLKDNMVLGTMMVAQGEVDGIVSGAVNTTANTIRPPLQLIKTAPGSNLVSSIFFMLMPEQVLVYGDCAINPDPSAEQLADIAIQSAQSAASFGIEPRVAMISYSTGNSGSGSDVDKVREATRIAKQKCPELIIDGPLQYDAAVMPNVAQSKAPNSPVAGQATVFVFPDLNTGNTTYKAVQRSADLISIGPMLQGMRKPVNDLSRGALVDDIVYTIALTAIQSAQTALLE

SEQ ID NO: 1774 - protein, 740 aa, Alteromonas macleodii ATCC 27126
MGDSRRSCNLRVNYISNANALAKAGVTMSRRIMLIPVGTSVGLTTVSMGLVRAIEEQGIKLNFFKPVAQPRKGDNGEERSTAIIAHHASVSPITPFELEYVERMISNDSTDELLEEIIERFEESSVQEAVTVIEGLVTTRHHPYAERLNLEISRALDADIVFVAVPGNESTTDINHRLEIVVDTYGGHKSQKVVGCIFNKVNASFDEHGRLRADIGAIEAPEHDEERTQALRDLPIFKKGLSLLGTIDWSADLVSPRATDVAKHLNASLLNEGELAERRLSSVTFCAREIHNMTHTLKPGALLVMSGDRGDVFVSCCLAALNGTKLGALLLTGGYQPDENIMALCSQAMETGLPVMLVNSNTWQTAQALHAFNQEVPVDDSKRIEKVMVHTAESLDASWVNSLTQKVSRQKKLSPSAFRFYLTNRARQVNKRIVLPEGNEPRTVVAASICAKRGLARPVLLGDETEIRRVAEQQGVVLSEGVEILSPSAIKKDYVESLVALRGHKGVTEVVAQELLEDNVTLGTMMLQQDDVDGLVSGAVNTTANTIRPALQLIKTAENASLVSSVFFMLLPDQVLVYGDCAINPDPNAQQLADIAIQSAESAQMFGIEPRVAMISYSTGSSGAGSDVEKVREATKIAQSLRPDLLIDGPLQYDAAAIESVGKSKAPNSPVAGKANVFVFPDLNTGNTTYKAVQRSFDLVCIGPMLQGMRKPVNDLSRGALVDDIVFTIALTAIQAAGNV

SEQ ID NO: 1775 - protein, 714 aa, Pseudoalteromonas atlantica T6c
MARRIMLIPVGSSAGLTSVSLGMVRAMQQQGLKVNFFKPMGQPRHGDDEPEKSTTIITQLGPTKPATPLTSAYVEDMISNDKMDVLLEEIIALYETHYADEDIGIIEGLVSTPSHPYAVRLNREICNALDAKIVLVSSPSNLTMNQLNDKLEIVADNYGGHRSKKVLGCIFNKINAPLDVRGHLSTELLENHDESKTAEIIKRLENLPIFNKTFALLGCISWSFDLIAPRVDDLRKHLNAKLLNEGDYKHRRLRSVNLCAREIHNMVWVLKPGALLVISGDRNDMFVMACLAAQNGTKIGAILLTGGYEPDPRVMALCSQAMETGLPVMLVDDNTWQTSLNLHFYNLEVPVDDEQRINRVMDHAASCIDPHWINSLSAGASKALRLSPPAFRFKLTQLAKAANKTIVLPEGDEPRTIKAAAICAERGIANCVLLGYKVEILRVAEQQGVVLPDSVTIQQPQDIQAHYIAPLVELRKHKGLTDVVAQEQLLDNVVLGTMMLKQGDVDGLVSGAVHTTANTIRPALQLIKTAPGASLVSSIFFMLLPEQVLVYGDCAINPDPTAEQLADIAIQSADSAAAFGIEPKVAMISYSTGTSGTGVDVDKVKKATELAQQKRPDLLIDGPLQYDAAVMESVASKKAPNSKVAGQATVFVFPDLNTGNTTYKAVQRSANLVSIGPMLQGMGKPVNDLSRGALVDDIVYTIALTAIQATQLNS

SEQ ID NO: 1776 - protein, 717 aa, Alteromonadales bacterium TW-7
MAHRIMLIPISTGVGLTSVSVGLVRALEQKAVKVNFFKPIAQPRSGETGPEKSTQIIKQGSPIDPPTPFALDYAEQMIGDAKGDDLLEEIVERFESKINDDEVAIIEGMVPTRKQPYAGRVNREIAQTLGADIVFVLTPGNDNITQLEDRLEIAAGNYGGIDHPRVLGCIFNKVNAPLDEEGRARADLVDSYKPDEVDNELNRLASLPIFRKNPFMLLGAIPWDFDLVAPRVKDLSAYLKATIINEGDMLHRRLRRITFCARTVSNILNHFTPGALLVTPGDRSDILVAACLSAMNGTKIGAILLTGGFMPEQRIMALCEQAMQTGLPILATEADTWRTSLLLHNFNMEVPSDDDQRIEKVKSHNAEYIDSDWLNSLAKNVGKTRKLSPPAFRYLLTDKARKAGKTVVLPEGNEPRTIKAAAICGQRGIAKTILLGDREEIMRIAEQQGIELNENVSIVEPSSIINDYVEPMVEIRKSKGLTAVVAQEQLLDNVVLGTMMLEQGKVDGLVSGAVNTTANTIRPPLQLIKTAPGSSLVSSVFFMLLPDQVLVYGDCAINPDPNAEQLADIAIQSADSAAAFGIEPRVAMISYSTGTSGTGADVEKVREATKIAQQKRPDLIIDGPLQYDAAIMENVALKKAPNSPVAGKATVFIFPDLNTGNTTYKAVQRSADLISIGPMLQGMRKPVNDLSRGALVDDIVYTIALTAIQAAQVEALN

SEQ ID NO: 1777 - protein, 715 aa, Pseudoalteromonas tunicata D2
MSHRIMLIPVSTGVGLTSVSVGIVRALEQKAVRVNFFKPIAQPRAGESGPEKSTEIVKLGSNIKPPMPIELKYAEQMIGDGKGDILLEEVIARFEESVHDGEVAIIEGMVPTRKQPYAGRLNREIAQALGAEIVFVLTPGNDPLDQIEHRLEIAASFYGGVENERVLGCIFNKVNAPLDEEGRARADLAEQFDPENLVAEQNRLAAMPLFRKHPFKLLGSVPWDFELVAPRVSDLARYLKAEILNEGDFAHRRLRSVTFCARTVSNILCHFTPGVLLVTPGDRSDVLVAACLSAMNGTKIGAILLTGGFIPEDRIMKLCEQAMATGLPILSTQADTWRTSLLLHNFNMEVPIDDEQRIERVKDHNAAHLDADWLQSLTKGVEKTRKMSPPAFRHLLTTKARLANKTIVLPEGTEPRTIKAAAICGERGIAKTVLLGEREEILRIAEQQGVQLNDAVTIIDPVDVRENYVAPLVELRKNKGMTEVIAQEQLLDNTVLATMMLAQGQVDGLVSGAVNTTANTIRPPLQLVKTAPGSSLVSSIFFMLLPDQVLVYGDCAINPDPTAEQLADIAIQSADSAIAFGIDAKVAMISYSTGTSGVGADVEKVRLATELAQAKRPDLIIDGPLQYDAAIMESVARKKAPNSLVAGKATVFIFPDLNTGNTTYKAVQRSAKLISIGPMLQGMRKPVNDLSRGALVDDIVYTIALTAIQATQVTH

SEQ ID NO: 1778 - protein, 706 aa, Colwellia psychrerythraea 34H
MPHRIMLIPVGSGVGLTSVSLGLLHACQQKGIKVGHFKPISQPSRNSLAKKNKTIDAISLSQNSTSVSLSYVEGKMGDGLHDVVLEEIVANFNAFKEDHDVIIIEGLVPTPRQPYAGRINRDVAQALGANIVLVASPGNDSAEEFEDRLEVSAETYGGIKNRHLIGCVINKLNCPDQEEFGLLPKEEEIENDFNLNHWLDLSIFKGRHFDLLGTVQWEIDLIAPRVCDISNYLEAKVINNGDMEHRRFRSVAFCARTVSNLVSYLVPGRLIVTPGDRTDIIIAACLSALNGTKLGGLILTNGFEPSEQVWELCKQALDAGLPVLSVPWDTWQTSRHIMGFNPEIPKDDIQRQDKVKQHVADNLSSSWLESLTSKNNSYNLLSPPAFRHKLTELARQANKLIVLPEGTDIRTIKAAAICCERNIARCQLIGNKEEILQIAEHQGINLPDNLLITDPDSIRDNYVGPMVELRKNKGLTDVIALENLKDNVVLATMMLQLGQVDGLVSGAVNTTANTIRPALQLIKTAPDSSLVSSVFFMLLPDQVLVYGDCAINPEPNAEQLADIAIQSADSARAFDIEPRVAMISYSTGRSGHGADVEKVAKATEIAKAKRPDLIIDGPLQYDAAIMENVAKKKAPNSPVAGKATVFIFPDLNTGNTTYKAVQRSADLVSIGPMLQGMNKPVNDLSRGALVDDIVYTIALTAIQATM

SEQ ID NO: 1779 - protein, 699 aa, Marinomonas sp. MWYL1
MSINVLMTVPTGPGVGLTSVSVGLVRALEQQGLKASFFKPIAQPQPGDKGPDKSTAMVAQGSTLTPAEPIPLHEAERYLYNDNIDELMEEIVGRFQASVEPDSTVIVEGLAQIAGHPYATRLNKAIARTLDAGLVLVTAPNNMRVNELEHHVEIAAGSYGGIKANDVIGCILNKTTPGSLGVKSYGDLFAQRGIFKRNFSLLGQIPKADELTYPRVKDVADFLGARIINAGEIESRRVQSYTLCARGVENMLEALRPGVLVFTPGDRTDIIMATAIAALNDIKIAALVVTGGYQPSEALMALCGKAMAKGLPVLSVESNSWETVINMQSFNQEIPLDDKERVLMVKEHIARCIDHDWINSFALNQEERKLSPPAFRFRLIELARSLNKRIILPEGEEIRTIQAASICAERGIARCTLLGNETEILRIAQNNGIELSHGVEILDPNSIRERYVAPMVELRKSRGLTDIVAREQLEDNVVLGTMMLQAGDVDGLVSGAVHTTANTIRPALQLIKTSPNSNLVSSIFFMCLPDQVLVYGDCAINPDPTAEQLAEIAIQSADSAAAFGIAPKVAMISYSTGGSGTGNDVDKVREATAIAQKLRPDLLIDGPLQYDAAIMEKVAKQKAPNSKVAGKATVFIFPDLNTGNTTYKAVQRSADVVSIGPMLQGIRKPVNDLSRGALVDDIVYTIAITAIQAGKLKSE

SEQ ID NO: 1780 - protein, 691 aa, Marinomonas sp. MED121
MTVPTGPGVGLTSVSVGLVRALEQQGLKASFFKPIAQPRPGDFGPDRSTAMVAQGSTLTPADPIPLHEAERFLYNDQIEELMEEVVARFQSSIEADSTVIIEGLAQIPGHPYATRLNKAIAKTLDASLVLVTAPNNMRVNELEHHVEIAAGSYGGIKAEDVIGCILNKTIPGSLGAKSYGDSFAQRPIFKRSFNLLGQIPKTEELTYPRARDVADFLNAKVINAGEMDTRRVQSFTLCARGVENTLPALKPGVLVFTPGDRTDIIMATAIAALNDTKIAALVLTGSYQPSEELLKLCGKAMAKGLPILSVDTNSWETAIGMQSFNQEIPLDDRQRISLVKEHMARCIDHEWISSFALNQDERKLSPPAFRYKLIEQARALNKRVVLPEGEEIRTIEAASICTERGIARCVLLGDKAQIHRIAHNNGIELHPDIEILSPNSIRDRYVAPMLEIRKHKGLTDIVAKEQLEDNVTLGTMMLQTGDVDGLVSGAIHTTANTIRPALQLVKTSSNSSLVSSVFFMCLPDQVLVYGDCAINPDPSAEQLAEIAIESADSAIAFGIPARVAMISYSTGGSGAGNDVEKVKRATELAKTKRPDLLIDGPLQYDAAIMEDVAKQKAPNSKVAGRATVFIFPDLNTGNTTYKAVQRSADVISIGPMLQGIRKPVNDLSRGALVDDIVYTIAITAIQSGHNP

SEQ ID NO: 1781 - protein, 685 aa, Dichelobacter nodosus VCS1703A
MTKSILLVATHRGAGLTSSVLGLSHAIEKLGVKVALHKPVLQCACEASCACNSAATCTDRALSISPERIQQALKNQKIDELMEEALQHFVAAKADADIVVMEGLLETPNAPYAHLINQKIARSLGADVIVVSSADVESIDRLERRLSFAGEYFAGRLLGAIINRVGGEGNLTQECLQKSSCFNDALPLLATISENAELAAPRVLDLQRHLDAEILFSGEINSRRIYDYVLFARSVQNAIPVLRDGVCVFSPADRDDTLMAVTTAVASGTHLACLVLTGEERSDDAVMRLCKPLLEKSKLPVLRIKRDSWESTRAMEGFNAHLAADDKERIEKIRTFFVEHLNKEWIKNYVARGDEQRLSPAAFRYNVVQKAIAAKKTIVLPEGDEPRTVVAASQCAARGMAKCVLLAKPERVHAVAAEQGVTLGDGISIIDPEQAREQYVARLVELRKHKGMDEATARSQLENNVMLGTLMLEAGEVDGLVSGAVHTTADTMRPPLQLIKTAKGASMVSSVFFMCLPEQVLVYGDCAIVPKPTVDDLAQIAIQSNDTAKAFGIEPKVAMISYSTGNSGQGEDVEKVKAATAKVRELRPDIIVDGPMQYDAASVASVGRAKAPNSPVAGQATVFVFPDLNTGNTTYKAVQRTAHAVSMGPVLQGMRKPVNDLSRGALIEDIVYTIALTAVQATLAE

SEQ ID NO: 1782 - protein, 704 aa, Cardiobacterium hominis ATCC 15826
MRSARKEGDMAKAILVVATHPGIGLTSTVLGLYHALDRKGVKVGFHKPVMQYDVESQDVDHSRAVLLHSSRAVGDDALVIRPEAVQQALDADNLDELMETVIQNFEAAKGDADVVIMEGLLETPNVPYAGECNRQIARALGADVILLSDARVSSIARLENRLDFAANAFGGYEKGHLLGAIVNYADGAGALSRAEIENSKAFNANFKLLGVISSRPEIAAPRVSDLQQHLDATVLFEGESSTRRILDYVLFARTPANAADFLRPGYCIFLPADRDDALMATTISAKAGNNLACLVLTGPLPASDVVMNLCKPLIEEAKLPVLHLGTSSWEISKLIEKFNRYIPVDDEQRIRETKEYFADGIKDDWFAGYLSAARSVSLSPAAFRYQIVQRAIAAQKTIVLPEGDEPRTVVAASICAERGMARCVLLAKPESVQAVAAQQGVTLGDNITIIDPAAVREKYVARLVELRKAKGMTEDQAREALEDGVMLGTMMLEAGEVDGLVSGAVHTTANTIRPPLQIIKTAPGASMVSSVFFMCLPDQVLVYGDCAIVPNPTADELAQIAIQSNDSAKAFGIEPRVAMISYSTGSSGSGADVEKVKEATAKVRELRPDILVDGPLQYDAAAVESVGKQKAPNSPVAGQASVFIFPDLNTGNTTYKAVQRSANAISMGPVLQGMRKPVNDLSRGALVDDIVYTIAITAVQAAHS

SEQ ID NO: 1783 - protein, 771 aa, Phytophthora infestans T30-4
MWTLRHSLRRSVGMALPHRRALTAAAISQGKVPINNLYVTSTEVTKKTAPVLIGLAHVLEQKFTKVGYFRPIQPSPDSSMADHHVDVMKHQLELSKDVEELYGVTSSRAMEAMLTGKGDDIVEEILERYEECRKGHDFMIIEGSQVSKHESAMSWKINVDIAKAIGSPVLMVTDFGDTSASSNALLEEMVSRTVMGRDQAEAAGLNYLGTIANRVRAKDVATLREDLKLKMGKKEIPFLGFLPMDEIIASKRLNEVTHQLGAKQLFGNSIANDAVVTSAVVAASALKDLFAHLKKYKDGAMIITSGDRSDLMLGLMVSRLPGVLPNISAIVLTNGNYPHSNTQEILKGVEALDKTGLSLPIFSTPNDTNSTADGFAKVSTYILPSSKLKIDRSKQLFDEFVEKEMLIGELDEGMVVSRSPKQFQHFLFSKSRAVQRHIVLTEGEDIRVLQAADQILRQNLSRITILGDPDEITVNAKMANLDLSRANIIRPVDSHLLDKYVDYFYAKRKHKGVTRELARDYCKDETYFGTLMVELGDADGMVSGACHTTANTIRPALQLIKTTPNRPIVSSIFFMCLKDGVRIYGDCAVNTDPSAQDLAQIAVTSAESAEAFGLIPKVALLSYATGDSNSGPIIDKVREATKMAQELRPDLDIYGPIQYDAAVDESIAKTKLKAIPSGAKVGGQANVLIFPDLNTGNNTYKAVQQSTGCIAMGPMLQGLRKPVNDLSRGATVKDIVTTVAITAIQADQVILKREAENSKNQNGEFLESATM

SEQ ID NO: 1784 - protein, 761 aa, Phytophthora infestans T30-4
MWTLRNTFRRTSVALPSQRRALTAAAIAEGKVPINNLFVTSTEVTEKTAPVLIGLTNTLEQKFARVGYFRPIQPIVETDHHVDVMKQQLGLTKSVEQLYGVTSERAIEYWLNGKGDDLVEEILDRYEACREGHDFMIIEGSQLSKHESAMSWKINVDIAKAIGSPVLTISDFSESANTNSDLLEEILSRTAFNKDQVEGAGLNFIGNIANRVNTKDPKALREAIRAKLREKDLPFLGFLPKDDFIASKRLNEVTHQLGAKQLFGTKAIPNNVVVTSAVVATSALKDLFAHLKNYKDGALVITSADRSDVMLGLMASRLPGILPNVSAIVLTNGSYPHSNTQEILQGVEALDKTGLSIPIFSVPEDTFTTADKFSKVSTDILPTSQLKIDRSKQLFDEFVGKEGIIGELDEGMVVNRSPKQFQHFLFSKSRAVQRHIVLTEGEDIRVLQAADQVLRQKLSKVTILGNPDDIERHAKSLTLDLSRANIVRTADSELLDKYVDQYFEKRKHKGVTRESARDAVLEETCFGTMMVEMGDADGMVSGACHTTANTIRPALQLIKTTPNRPIVSSIFFMCLEDGVRIYGDCAVNTDPSAQDLAQIAVTSAESAEAFGLIPKVALLSYATGDSNSGPIIDKVREATKMAQELRPDLDIYGPIQYDAAVDESIAKTKLKAIPSGAKVGGQANVLIFPDLNTGNNTYKAVQQSTGCIAMGPMLQGLRKPVNDLSRGATVKDIVTTVAITAIQADQVILKREAKAKVEAAA

SEQ ID NO: 1785 - protein, 792 aa, Chlamydomonas reinhardtii
MSLNSSTMSRRQAVAGAPAVAPFRHAGLFPRVRLCANRRVARVAPKAAGNGNIAQGEQGFDTLFLSDISLVGQRTPLLLGFFNYFERHLPHVGFFEPIAAEALASSELRIDRHVELVYKVFNLKGDVRAMTGVQDAEAARMIANGQHSELLDKIYSQYASYKEGQDLVLVEGPGPLMGGTELDAQIAAALNAPVLMTMTGQPNATVADYYNRAMVKRQVFLDHHVEVLGLVMNGLPRQSHAILSGQLRDKFAAAGLPFAGAIPTDIMLRNVRLDEVQTAMGAQRLYGDSLLTDVEFDDVVVASQRLEELLEILAERPMGRPLVVTSADRLDIVLGLLAAQLSVSGPGVAGILLTQAGSARSGRNYARDTIDRIFAGLSSSGLYKGSLLPVLVTDMPLRDAIRKLDNLDAAILPSSTRKISQCKRLFEQYVDANAVVARLQNMVRPNRMTPKMFMHTLKSMCNATPQHIVLPESEDKRVLAAAADVVQRGLAKITLLGDPTTILAEAAKLGLDLSGCNIHNPNTSDRFDKYVDMLVEARKKKGMTREVAADTLHGDVNFFATMMIVAGDADGMVSGAVHTTASTVRPALQVLKSPDTPLVSSVFIMCLPDRVVVYGDCAVNVNPSAADLAQIAITSNDTAAAFGIEPRVAMLSYSTLGSGSGPDVQKVSEAVAIVKQRRPDIKVEGPIQYDAAIDPKVAAVKVQGLSEVAGKATVFIFPDLNTGNNTYKAVQQSTGAIAMGPVMQGLLRPVNDLSRGCTVPDIINTICVTSIQASRMSSAARAAAAKAAVAAV

SEQ ID NO: 1786 - protein, 788 aa, Physcomitrella patens subsp. patens
MLRAVGKKVRRVLREELLAGLQGRGLGRIYDASGTGVRKHGWGISSRETHTNSLYIHHTIGGVGRDSVAVTVGLLHSLERLQPGIGYFRPIDQTTIGGYRSKLIKSVFKMKDDPAIMQGVTQDRAYELVTNDKIDDLLEEVLKAYEACRVKHDFVVVEGTSLRGGGDDTVTLNAKIAQTLGSSALLVTDAGIACGKMDKMKNWDGFDWEKRVVNNAKLSDLVFRREHVDVVGAIVHRTPQTERKDKLLRKVFEEMKIPFVGALPEDSVLRSVQVQDVAKKLEAGLLYPVEDEEVAMSTEVTQYLVATEQLSDLLRHLPRYVDPTKGSIVITSANRVDILLGLIHLHESKSNANIAAVVLSGGKPPPREVHELLKARNSGTLPIILSPQMTFETASALANVEGYISSKTPLKVERAQTLFDDNINMKLIKDAMFQERPVRMNSKLFQHNLFTRAKQCIQTIVLPEGEEPRTLQAAGTVLRRGLCNLILLGDREKIETLAKQFRVDISQARIVDPRDCPETEKYARYFYESRKHKGITLGQAHNILIGDVNYFGTCMVAEGAADGMVSGAVHTTANTVRPALQLIKTLPGIPVVSSVFFMCLPGKVLVYGDCAINSDPTSEELAAIAIASADTAAAFGIKPRVAMLSYATGDSNKGPLIQKVIDATAIARKLRPDLLIEGPLQYDAAVDPVIAKTKMKGAESEVAGKASVLIFPDLNTGNNTYKAVQQTTGAVAMGPLLQGLRKPVNDLSRGCTVPDIVTTIALTAVQAAAMKETAKRETPKENLVASAA

SEQ ID NO: 1787 - protein, 698 aa, Cyanothece sp. ATCC 51142
MTNSIYISTLEPRSGKSLIALGMIELILRKTTKVGFFRPIIQDSIDHKPDKHIDLILSYFKLPQSYDDSFGLYYSEVNHLMEQEKLDEILDKIISKYKKLEENCDFIVCENSDYVGENSAFAFEINVAIAKTLGCSLLILGNGYQKSLQEISISLKIVADAYREKHCRILGIIINKVSSSDRKNLENHLEKTYRKNNYLFSVIPYDKKLDSPRMKEVAEQLKAKVLYGEKRLNNLVFNYLIAAMQMQHAITQLQDNDLVVTPSDRGDVIIGALQAHQSTNYPNLAGILLTTECELEKSIGRLIGGLSDPLPILWVDTYTYPTASRLQTVDSSLKAGDIEKINWSIELFDQSVNLTMLEHLINKIEVEGITPKMFTYNLIQKAKLNKRHIVLPEGKDPRILKAVATLLSQDIVDITVLGEKKRIERTIQSHGIQLDINNLKIINPLSSPKLDDYIKTLYELRKHKGITLENAKDMLMDVSYFGTMMVYSGDADGMVSGAIHTTGNTIRPALQIIKTKPEYQLVSSVFFMCLGDKVLVYGDCAINPNPTAEQLAEIAVISAETAQTFGIFPRVALLSYSSGESGTGEDVERVKQATILAQKRRPDLLFEGPIQYDAAVDKTVAAQKMPDSEVAGQATVFVFPDLNTGNNTYKAVQRETGAIAIGPILQGLKKPVNDLSRGCTVEDIINTVVITAIQGSDN

SEQ ID NO: 1788 - protein, 698 aa, Cyanothece sp. CCY0110
MTNSIYISTVEPRSGKSLIALGIIELILRKTTKVGFFRPIIQDSIDNKPDKHIDLILSYFKLSQTYEDSFGLHYAEVNHLMEKEKLDEILDKIIRKYKKLAENCDFIVCENSDYVGENSAFAFDINVAIAKTLGCSLLILGNGHQKSVKEISVSLKIVADSYREKHCKILGIIINKVAHSDINFLNNYLQQTYSKNNYLFSVIPYDKKLNSPRMKEVAEQLKAKVLYGEKRLNNLVFNYLIAAMQMQHAITQLEDNDLVVTPSDRGDVIIGALQAHQSMNYPNLAGILLTTECELEPSISRLIGGLNDALPILWVDTYTYPTASRLQTVYSSLKAGDIEKINWSIEVFDQSVNLVMLEHLINKIEVEGITPKMFTYNLIQKAKLNKRHIVLPEGKDPRILKAVATLLSQDIVDITVLGEKNRIERTIQSYGIQLDINSLNIINPLNSPKLDDYITTLYALRKHKGITLENAKDMLMDVSYFGTMMVYSGDADGMVSGAIHTTGNTIRPALQIIKTKPKYQLVSSVFFMCLPEKVLVYGDCAINANPTAEQLAEIAIISAETAQTFGIFPRVALLSYSSGESGTGEDVERVKQATMLAKKRRQDLLFEGPIQYDAAVDKTVAAQKMPDSEVAGLATVFVFPDLNTGNNTYKAVQRETGAIAIGPILQGLKKPVNDLSRGCTVEDIINTVVITAIQASNN

SEQ ID NO: 1789 - protein, 707 aa, Cyanothece sp. PCC 8802
MTNSLYIATTEGKTGKSLISLGIMELLLRKTTKVGFFRPIIQDPIDHQPDQHLNLILSHFNLPQNYEESYGLPYSEVSNLMGHQNLDEILEIIITKYKKLEETCDFILCEGSDYLKESSAFEFDINAKIAKNLGCSILILGNGYQKSVEEAIAPIEIAVDTYREKQCPIIGIIINKADQSQFKLLKNVLEKDYKNTNYLLSIIPYDKKLGSPRIREIAQQLNAQILYGRDRLDNLVFNYLVAAMQMQHAISQFDENCLVVTPSDRGDVIIGTLQAHQSTNYPNLAGILLTTEYQLEQSIAQLISGLTDPLPILWVNSYTYPTVSDLKAVYSSLIPEDTEKIDWSIDLFDQFVNLTTLEKQISTIEVKGITPKMFTYNLIQQAKTQKRHIVLPEGNEPRILKAAEVLLSKNIVDLTLLGQKKEIERIVKTNNIQLDIQQLTIINPIESAKFDDYVQTFYDLRKHKGATLETAHDCIMDVSYFGTMMVYKGDADGMVSGAIHTTSHTIRPALQIIKTQPDISLVSSVFFMCLNHNVLVYGDCAVNPNPTAEELAEIAITSAETAKTFDITPKVALLSYSSGESGQGEEVEKVRKAAQIAQKRRQDLAIEGPIQYDAAIDPQVAAQKMPNSRVAGQATVFIFPDLNTGNNTYKAVQRATGAIAIGPILQGLKKPVNDLSRGCTVGDIINTVVITAIQSQIHLTGRMGNGQ

SEQ ID NO: 1790 - protein, 701 aa, Cyanothece sp. PCC 7424
MTSSLYISITEPNSGKSIITLGILELILRKTFKVGFFRPIIQEESQRKKDRHIDCLINHFQLPQSYQESYGVTYAEVNQLMGQKKIDDILEKIIVKYKKLEQKCEFILCEGSDYLGESSAFEFDLNIEIAKNLGCPILILGNAYQNSLDDALAPIQVAVNAYREQHCQIVGIIINKVTKSLVQLLKKNLEQEYKDSGYLLAVIPYSKRLASPRVREVVALLQAQVLYGHSQLDNLVFGYLVAAMQMQHAIPQFRVNDLIVTPSDRGDIIIGAIQAHQSTNYPNLAGIVLTTEYPLDTSIRTLIEGLGETLPILWVSSYTYETASRLQSMNSSISAGDKEKINWSIELFEKYVDWTELEKQISTIRVQGMTPKRFTYNLVQQAKWQKKHIVLPEGKEPRILAASAVLLSREIVDITLLGRPSDIEKTIRNNGINLDINNLKIINPVESENFEYYAQSLYEVRKHKGMTLDAAKDLLADVSYFGTMMVYQGDADGMVSGAVHTTQHTIRPALQIIKTEPDCSIVSSVFFMCLSDEVLVYGDCAVNPNPNAEQLAEIAISSALTAKRFGIDPRIALLSYSSGESGVGVEVEKVRQATQIAKQRRPDLKLEGPIQYDAAVDKAVGAQKMPGSEVAGQANVFIFPDLNTGNNTYKAVQRETGAIAIGPILQGLRKPVNDLSRGCTVEDIINTVVITAIQAQSLNCD

SEQ ID NO: 1791 - protein, 698 aa, Microcystis aeruginosa NIES-843
MTNSLYISTTATGSGKALVALGIIDLILRKTNKVAFFQPIVLDCSQGHRDEDIDLILNYFKLEQTYEEAFGLCYDEVKDLLVQQKFDEIIERIIKKFKNLEKKYDFILCEGSDYLQENSAFEFELNTEIAKNLGHPILILGNAHNRSIEDALSPILISCDTYQDKGCTVIGIIINQAEEEKIGELRKTLTKIFPPQEYALGVIPHNAKLSSPRVAEIAQQLQAKVLYGQQRLDSLASNFLVVAMQMQNALERIKEDSLIITPWDRGDVIIGMLQAHQSANYPQLAGIVLTAGHNLNPSIARLIEGLPDPLPILSVTTDTYTTAERIHDVRTTLTSTDYDKINLSLQLFHSNINLDRLEAQIHTLRTQGITPKMFTYNLVQQAKAQKRHIVLAEGTEPRILQAATVLIEQDIVDLTLLGQPDEIAMVIKKHGITLDLDRLQIIDPVASPHFESYVQTLYEARKAKGMNLDMARDYAQDVSYFGTLMVYQGDADGMVSGAVHTTQHTIRPALQIIKTKPDCAIVSSVFFMCLEDRVLVYGDCAVNPDPSAEELAEIALSSAETAQKFGIEPRIALLSYSSGQSGQGEDVEKVRQATKIAREKRPDLKLEGPIQYDAAVDREVAAQKMPGSEVAGQATVFIFPDLNTGNNTYKAVQRETKALAIGPILQGLKKPVNDLSRGCTVPDIINTVVITAIQSQSF

SEQ ID NO: 1792 - protein, 698 aa, Cyanothece sp. PCC 7425
MTHSLYISTTEAGSGKALASLGIIDLILRQTTRVHFFRPVIQTKNKRDEDIELILTYFGLNQTYEESFGLSSQEVNELLGQHQASIALEQIIAKFKRLEQRGDFILCEGSDYLGEGAAFEFNLNQEFARNLGCPILILGRADNRTPEATLRPIQMAVDAYRQHNCQVMGIVLNRASPDQVVTLKAALKTRYGEDGYLLAVIPSDPRLGSPRVRDIADQLQAEVLYGHTHLDNLVPHFLVAAMQMQHALSWLKDNSLVITPGDRGDIIVGMLQAHQSTKYPQLAGLLLSTGLKPDPAIATLIEGLPDPLPILSVKTDTYTTASLVKEVRSSLIPEDKEKISLSIRAFDDHVDLREFKQQISTIQVQGITPKMFTYNLLKQASTEPRHIVLPEGTDPRILKAAAVLTSRGIVKLTLLGQRAKIEQVIKQQRIELDLNALSILYPPESSRLEHYAQTLHQLRQHKGITLEAAHDYLMDVSYFGTMMVYEGDADAMVSGAVHTTQHTVRPALQIIKAKPGFSIVSSVFLMCLEDRVLVYGDCAVNPNPTAAELAEIAITSADTAQSFGIEPRVALLSYSSGDSGQGDDVDKVRQATQIAQARRPDLLLEGPMQYDAAVNPQVAAQKLPGSIVAGRATVLVFPDLNTGNNTYKAVQRETGAIAIGPILQGLKKPVNDLSRGCTVEDVINTVAITAIQAQTLSS

SEQ ID NO: 1793 - protein, 697 aa, Synechocystis sp. PCC 6803
MTSSLYLSTTEARSGKSLVVLGILDLILKKTTRIAYFRPIIQDPVNGKHDNNIILVLENFRLQQTYTDSFGLYFHEAVSLASDGAIDQVLDRILAKYRHLADQVDFILCEGSDYLGEESAFEFDLNTTIAKMLNCPILLLGNAMGNTIADSLQPIDMALNSYDQESCQVVGVIINRVQPELATEIQAQLEQRYGDRPMVLGTIPQDIMLKSLRLREIVSGLNAQVLSGADLLDNLVYHHLVVAMHIAHALHWLHEKNTLIITPGDRGDIILGVMQAHRSLNYPSIAGILLTADYHPEPAIMKLIEGLPDAPPLLLTSTHTHETSARLETLHPALSPTDNYKIRHSIALFQQQIDGEKLLNYLKTIRSKGITPKLFLYNLVQAATAAQRHIVLPEGEEIRILKAAASLINHGIVRLTLLGNIEAIEQTVKINHIDLDLSKVRLINPKTSPDRERYAETYYQLRKHKGVTLAMARDILTDISYFGTMMVHLGEADGMVSGSVNTTQHTVRPALQIIKTQPGFSLVSSVFFMCLEDRVLVYGDCAVNPDPNAEQLAEIALTSAATAKNFGIEPRVALLSYSSGSSGQGADVEKVRQATAIAKEREPDLALEGPIQYDAAVDSTVAAQKMPGSAVAGKATVFIFPDLNTGNNTYKAVQRETKAIAIGPILQGLNKPVNDLSRGCLVEDIINTVVITALQVK

SEQ ID NO: 1794 - protein, 698 aa, Leeuwenhoekiella blandensis MED217
MNKGIYIATLEPNSGKSIVSLGLMRTLLGKTAKVGYFRPIIDDSKNTGKDNHISTVLSFFDIKLDYEDAYAFTSSELIKKRNKGKSGEILDTIITKYKNLEDRFDFVLVEGSDFTGEGSVFEFDTNVLVAKNLGLPVILVGSGVNKTEDELLGSLQIAYTTFLEKDVSVLAVVANKVQEENLMVAKNGLSNFLPDSVEVFAIPYTEKLARPTIKEIVEELDGEVLFGAEFLDNQTGNFGVGAMQLRNYLTHLKQDSLVITPGDRADIILGALQANISTNYPRISGIILTGGLKPEEPILQLIQGLSQIVPIVSVNDGTFSVTNRVGNIKSQIYASSKPKIETSLTVFSKEVSFDKLIERLINLKPKGITPRMFQYGLMKRARTAKKHIVMPEGTDERILTAAIQLVELDIVQITLLGEVEKVKEKAVQLGLALDLDKISVINPVQSEHFDDYVETFYELRKHKNVNRDIARDWMADVSYYGTMMIYKGHADGMVSGAAHTTQHTIRPALQFIKTKPGVSVVSSVFFMCLEDRVSVFGDCAINPNPSATELAEIAISSAESSLAFGIEPKIAMLSYSSGTSGKGADVDRVREATEIVKKERPDLKIEGPIQYDAAVDAAVGKSKLPDSEVAGQASVLIFPDLNTGNNTYKAVQRETGALAIGPMLQGLNKPVNDLSRGCTTEDVFNTVIITAIQAQGFN

SEQ ID NO: 1795 - protein, 697 aa, Flavobacterium johnsoniae UW101
MSKAIYIATSDYNSGKSIITLGLMSILIGKTAKVGYFRPIIEDFVDGEVDNHIETVLSYFNLDIDFEDAYAITKSKLIKKKNKGKIGEVLDLIIEKYKKLEERFDFVLVEGTSFTGEGTSIELDLNVLIAKNLGIPTIIVGSGVGKTLEELLDSLYLVYDSFKVKEVEVLSVFANKVQPENIELVTKSLQKTLPSNVLINTIPLISSLNNPTMQEIVNELNAKVLFGENYLNNEIGHYSVGAMQLHNYLVHLHDNALVITPGDRSDIILGALQANESANYPTISGIILTGNIVPEESILKLIEGLSAIVPIIAVDGGTYHITNKIGSIKSEIYANNTHKIETSITTFEKYVNNDALSERLITFQAEGMTPKMFQYNMVKRAKQHRKHIVLPEGNDDRIITAASRLLDMDVVDISIIGDKKQIENKVVELGITLDFSKVNIINPIESEMYEDYANTYYELRKAKNVSITMARDLMEDVSYFGTMMVYKGHADGMVSGAAHTTQHTILPALQFIKTKPNSSVVSSVFFMCLEDRVSVFGDCAINPNPTAEQLAEIAISSAESSLAFGIEPKIAMLSYSSGSSGKGDEVDKVRTATAIVKEKRPDLKIEGPIQYDAAVDLSVGKSKMPDSEVAGQASVLIFPDLNTGNNTYKAVQRETGALAIGPMLQGLNKPVNDLSRGCTVDDIINTVVITAIQAQGM

SEQ ID NO: 1796 - protein, 698 aa, Robiginitalea biformata HTCC2501
MNKGIYVATIEANSGKSILSLGLMRLLLGKMARVGYFRPIIDDYPDGKQDNHIATILSHFNIPLNYEEAYACTRSQVVQKTSRNREDEVLDTIIQKYKDLESRFDFILVEGTDFTGEGAIIEWDFNVLLAKNLGIPTVILSTGVGKTLEEFVNSLALACDSFRDKGVEVLMVAANKIQPENRQLVLDQMHSDLPEGVLTAAIPLNPVLGNPSMREIADALGGEVLFGARHLDKQVAHFGVGAMQLRNYLTHLVEATLVITPGDRADIILGALQANLSTNYPSISGIILTGGLVPEETIIRLIEGLSEVVPIVSVQGGTFSVTNRIGSIQPRIYAGNTLKIEQSLKDFSAYVPEDALAERLVTFRAEGITPRMFQYNLLKKAQSDVKHIVLPEGADQRVLRAAVELARYQAVRLTLLGRPEEIREKARQLQLELPGEIQLLDPRNAPQFEEYANTLYELRKHKNMELTMAQDLMSDVSYFGTMMVHKGHADGMVSGAAHTTQHTIRPALQFIRTRPGVHLVSSVFFMCLPDRVTVFGDCAINPNPDAAELAEIAISSADTTASFGIEPRVAMLSYSSGSSGQGADVDRVREATRLVRERRPDLKVEGPIQYDAAVDLKVGRSKLPDSEVAGRATVFIFPDLNTGNNTYKAVQRETGALAIGPVLQGLNKPVNDLSRGCTEDDIFNTVVITAIQAQQIRK

SEQ ID NO: 1797 - protein, 698 aa, Flavobacteriales bacterium HTCC2170
MSKAIYIATTEPNSGKSIISLGLMQMLLGKAAKVGYFRPIIDDYTNGTKDNHIKTIISYFNLPIAYEDAFAFTRSEVIQMNNQNKEDEVLDKIIEKYKSIEDQFDFVLVEGTDFSGEGAIIEWDINVLMAKNLGIPTLILTSGVGKTLDELVNNVYLAYDSFKDHGVEVLMVVANKVQEKNLELVNESLQKVIPEEVLVGSIPMNPVLGNPTIKEIVDVLEGKVLFGEKYLNNQAGHFGVGAMQLRNYLTHLKKDGLVITPGDRADIILGALQANLSANYPTVSGMILTGGIIPEEPIAKLIEGLSDVVPIISVEEGTFSITNRIGAIRPKIYAENTHKIMTSIQDFSKYIPEEVLAKRLITSKSKGITPRMFQYNLLKRAKADKKRIVLAEGLDERVLKATKQLLDANAVEITLLGDPIQIADKISLMDLDLDLNSIEIENPTESKYFDEFSETLYELRKHKNVNLAMARDLMEDVSYFATMMVHKGYADGMVSGAIHTTKHTILPALHFIKTRPDVSVVSSVFFMCLEDRVTLYGDCAINPNPDAEQLSEIAISSAETSQAFGIDPKIAMLSYSSGSSGVGEDVERVRNATKLVKEKRPDLKVEGPIQYDAAVDINVGKTKMPGSQVAGEASVFIFPDLNTGNNTYKAVQRETGTIAIGPILQGLNKPVNDLSRGCNVDDIFNAVIITAIQAQDLE

SEQ ID NO: 1798 - protein, 697 aa, Polaribacter sp. MED152
MSKAIYVTTIEPNSGKSLISLGVLRMMLTKSTKVGYFRPIINKSKTDSFDNHTNTAINFFNLDLDYNDCHVYEQSEVVELLSEGKEDEIIHKIIGKYKSLEQRFDYVLVEGTDFSGEGGFTEIDVNLMVAKNLGIPVLIVGAGNGKKKKDFINTMQLTYNSFIQKEVDVIGLIANKTETDEIEYVKDQLAKSIAGDIQIDVIPKVDFLAYPTVKEVVEELEGKVLFGEQFLDNAIGSFSTGAMQLRNYLTHIKNNALVITPGDRADIILGALQANASSNYPNISGIILTGGLIPEDSIIKLIEGVQSTIPIISVKGGTFGISNKIGAVKPKIYATNRKKILLALDTFDAHVNATGLTNTLSNFNSERLTPSMFQYNLLQSARAHKKHIVLPEGNDERIIRAAARLQLLNIVDLTLLGDKREIQAKCNQLGIQIDLEQIQVLNPEDSIHNDAFGKTLYEARKHKGMTETTAKDLTRDVSYFGTLMILNGLADGMVSGAVHTTMHTIKPALQIIKTKPGVSVVSSVFFMCLSDRVSVMGDCAVNPNPNAEQLAEIAISSAQSAEAFGIEAKVAMLSYSSGSSGKGEEVEKVRKATDIVKTKEPSLKIEGPIQYDAAVDMSVAKTKMPDSAVAGQASVLIFPDLNTGNNTYKAIQRETGALAIGPMLQGLNKPVNDLSRGCTVDDIFNTVLLTAIQAEQG

SEQ ID NO: 1799 - protein, 696 aa, Polaribacter irgensii 23-P
MNKAIYIATVESDSGKSLISLGLLRVMLTKSAKVGYFRPIINEFDSDGYDEHTKTAINFFNLDIDYKDSFAYKQSEVVSLLSAGKGAEMIHNVIEKYKKIEANYDYVLVEGTDFSGEVGFTELDVNLMIAKNLNIPALIVGSGNGKKKKDFINTMQLTYNSFIHKEVDVLGIIANKIEEDEVDYIREELTKNFPEKLQIDIIPKIDFLAFPTVKEVVETLNGRVLFGAQFLDNAIGSYSTGAMQLRNYLTRIKENALVITPGDRADIILGALQANASKNYPKIAGIILTGSIIPEAPILKLIEGVQSTVPIISVDGGTFSVSNKIGAVQSKIYSTHNKKILLSLDTFDKYVNAEGLANILTSYRSQKLTPSMFQYNLLQKARIVKKHIVLPEGDDERILKAAARLQLLDIVDLTLLGDRNTIQLKCDQIGLQIDLNALNILNPENSIHNKDFATTLFEARKHKGMSETTAMDLVHDVSYFGTLMILKGLADGMVSGAVHTTMHTIKPALQLIKTKPGVTVVSSVFFMCLSDRVSVMGDCAVNPNPNAEQLSEIAISSAASAEAFGIEAKVAMLSYSSGSSGKGEEVEKVRKATTLAKEKNPNLKIEGPIQYDAAVDRSVAKTKMPDSEVAGQASVLIFPDLNTGNNTYKAIQRETGALAIGPMLQGLNKPVNDLSRGCTVDDIFNTVLLTAIQANQ

SEQ ID NO: 1800 - protein, 691 aa, Capnocytophaga sputigena Capno
MNKSVYVIAANTHSGKSVVSLGVLQMIMCNTAKVGYFRPIVESKSKKDTFIETVLEHFKLDMSYDEAYAYTRQEVIALKNEGNIGEVYDTIIKKYKALESKFDFVLVDSSSAVDDSYFDANFNASVAQSLNIPALVVLKDNFASEDELANQVQATLNNFIEKDVRVLSVFVNKATNATAATINCLEQRFSDTTFTVIPRKEELSRPTIREIANALNAEFLYKGDNIDVTTKRTIVGAMQLSNYLAKLNEDTLAVLPIDRIDLIAGSLVANYSNFSNIKGVVLYGDLTLNASMSKIFDGIQKNIPIMVAKTDTFETANIIGNTQAHIYPENTEKVKMLLQLFDENVDAEKLNNSIASFKSETITPRMFQYNMVQKARAGQKHIVLPEGTDDRILTAASQLAEDELVYLTILGEPEAIKTRAKNILGLKWNEDRINIINPAESEKYEAYAEKLYELRKSKGLELSQAKDLMLDASYFGTMMVFLGDADGMVSGAVNTTAHTIRPSLQFVKTKPGVNTVSSVFFMLLHDRVLVYGDCAVVPNPTAEQLADIAISSADSAIAFGIEPKVALLSYSSGNSGSGADVDKVREATALVKERRPELLVEGPIQYDAAVDPKVGKQKMPNSPVAGQANVLIFPDLNTGNNTYKAVQRETGGLAIGPMLQGLKKPVNDLSRGALIPDIYNTVLITAIQSEF

SEQ ID NO: 1801 - protein, 691 aa, Capnocytophaga ochracea DSM 7271
MNKSVYIIATNAHSGKSVVSLGVLQMIMRNTAKVGYFRPIVESKSKKDTFIETVLEHFQLDMSYDEAYAYTRQEVIALKNEGNIGEVYDTIIKKYKALESKFDFVLVDSSSTIDDSYFDTNFNASVAQSLNIPALIVLKDNFSSEVELVNQVQEDLNNFLEKDLRVLSVFVNKATNATADTLSKLEQRFKDITFTLIPRKEELSRPTIREIANALNVEFLYKGDNIDVTTKRTIVGAMQLSNYLAKLNEDTLAVLPTDRIDLIAGSLVANYSNFSNIKGVVLYGDLTPDPSMSKILDGIQKNIPIMIAKTDTFETANIIGNTKSSIYPENTEKVKMLLQLFDENVDAAKLNSSIASFKSETITPRMFQYNMVQKARAGQKRIVLPEGTDDRILTAASQLAEDELVYLTILGEPEAIKTRAKNILGLKWNEERISIINPAESDKYEAYAEKLYELRKSKGLELSQAKDLMLDASYFGTMMVFLGDADGMVSGAVNTTAHTIRPSLQFVKTKPGVNTVSSVFFMLLHDRVLVYGDCAVVPNPTAEQLADIAISSADSAIAFGIEPKVALLSYSSGNSGSGADVDKVREATALVKERRPELLVEGPIQYDAAVDPKVGKQKMPNSPVAGQANVLIFPDLNTGNNTYKAVQRETGGLAIGPMLQGLKKPVNDLSRGALIPDIYNTVLITAIQSEF

SEQ ID NO: 1802 - protein, 704 aa, Desulfovibrio vulgaris subsp. vulgaris str. Hildenborough
MSNNLYITATESKSGKSAVVLGMMQLLLRDVRKVAFFRPIINQASTDVRDHDINLILRHFGLDIAYEDTYAYSLQDARELINNGQHATLLDNILKKYKKLEDAYDFVLCEGTDFLGKDAAFEFELNADIAANLGCPVMVVANGQQKAARELIASTQLTIDLLDEKGLDVVTAVINRATVTEAEREEIIKSLECKVNCSNPLAVYVLPEESTLGKPTMNDVKKWLGAQVLYGHGRLDTLVDDYIIAAMQIGNFLDYVSQGCLVITPGDRSDIILSSLASRLSTAYPDISGLLLTGGLEPAANVHRLIEGWTGVPIPILSVKDHTYKTIQTLNELYGKIEPDNDRKINTALALFERHIDSSELGSRLINRKSSRITPKMFEFNLIEKAKRNRMRIVLPEGAEERILRAADILVRREVADIILLGDANTVGSRIGDLGLDMDGVQIVQPNLSPKFDEYVAAYHECRKKKGISMEQARDMMNDPTYFGTMMVHKGDADGMVSGAINTTAHTIRPAFEFIKTKPGVSIVSSVFLMCLKDRVLVFGDCAVNPNPTAEQLAEIAISASHTARIFGVDPRVAMLSYSTGSSGKGADVEKVIEATRIAKERAPELLLEGPLQYDAAIDMDVARTKLPGSTVAGQATVFIFPDLNTGNNTYKAVQRAAGAVAIGPVLQGLNKPVNDLSRGCTVADIVNTVAITAIQAQAEKGLI

SEQ ID NO: 1803 - protein, 704 aa, Desulfovibrio vulgaris str. 'Miyazaki F'
MANNLYITATESKSGKSAVVLGMMQLLLRDIRKVAFFRPIINRPVTDAVDHDTNLILTHFNLDIPVADTYAYSLQDARELINNGQHATLLENILKKYKQLEDSYDFVLCEGTDFLGKDAAFEFDLNADIAANLGCPVMVVANGQQKTAHEIVASTQLTIDLLDEKGLDIVAAVINRASVTDAERDVVISSLECKVNCSNPLAVYVVPEEPTLGKPTMGDVKKWLNAQVLYGHGRMDTLVDDYVIAAMQIGNFLDYVTPGCLVITPGDRSDIILTGLATRLSGAYPDISGMLLTGGIQPAPNVHRLIEGWTGVPIPILSVKDHTYKTIQTLNELYGKIEPDNERKINTALGLFERSVDSQELGRRLINRKSSRITPMMFEFNLIERAKQNRMRIVLPEGVEERILRAADILARREVADIILLGDADKVGAKVSELGIALDGVQIIQPNLSPKFEEYAQAYFELRKHKGVSIERARDTMNDVTYFGTMMVHKGDAEGMVSGSINTTAHTIRPAFEFIKTKPGFSIVSSVFLMCLKDRVLAFGDCAVNPNPTAEQLAEIAINSAHTARIFGIEPRVAMLSYSTGSSGKGADVEKVIEATRIAKERAPELLLEGPLQYDAAIDMDVARTKLPGSQVAGQATVFIFPDLNTGNNTYKAVQRAAGAVAIGPVLQGLNKPVNDLSRGCTVPDIVNTVAITAIQAQAEKGLI

SEQ ID NO: 1804 - protein, 719 aa, Desulfovibrio desulfuricans subsp. desulfuricans str. G20
MPDPGQMKWICKESNVSKNLYITATESKSGKSAIVLGMMQLLLRDVRKVAFFRPIINNTSKEVRDHDINLILTRFGLDIPYEKTYAYSLHEARELINNGQHATLLENILNKYKALEAEYDFVLCEGTDFLGKDAAFEFDLNADIAANLGCPVLVVANGLDKNSEEIIGSTQLTIDQLDEKSLDVVAAVVNRASVTPAEKDNIIKSLECKVNCANPLAVYVVPEEPTLGKPTMGDVKKWLGASVLYGHGRLDTLVDDYIIAAMQVGNFLDYLGQGTLIITPGDRSDIILASLASRLSSSYPDISGILLTGGLEPAANVHRLIEGWTGVPVPVLCAKEHTYLTTQILNDLYGKIDPEDDRKIATALGVFEQNVDTAEISNRIISRRSSRITPKMFEYNLIEQAKKHKMRIVLPEGAEERILRAADILVRRGVADLILLGNADEVGKKIGDLGLDLDGVTIIQPELAPNFEDYVQTYYEARKKKGISMEQARDIMSDPTYYGTMMVHKNDADGMVSGAINTTAHTIRPAFEFIKTKPTASIVSSVFLMCLKDRVHVFGDCAVNPNPSAEQLAEIALNSSDTARIFGIEPKVAMLSYSTGSSGKGADVEKVIEATRIAKERAPELALEGPLQYDAAIDADVARTKMPDSNVAGQATVFIFPDLNTGNNTYKAVQRAAGAVAIGPVLQGLNKPVNDLSRGCLVPDIVNTVAITAIQAQAEKGLR

SEQ ID NO: 1805 - protein, 705 aa, Desulfovibrio salexigens DSM 2638
MSKNLYITATEEKSGKSAIALGVMQLLLRDLQHVAIFRPIINDNQTGSRDHDINLIMEYFNLDISYEDTYAYTLKEARELINSGKHSLLLENILNKYSQLEEKYDFVLCEGTDFQGKDQNFEFDINAEIAANLSCPVLLVANGRGKSADDIIASTQLVIDALEDKGVDTVAAIINRLTATEEEKNEILSSIKCKTRCSQELLVYGIDENESLGNPSMNDVRKWLNGSVLYGHGRLDTLVDDYVIAAMRIGNFLEYIEDGSLIITPGDRSDIILSSLASRLSSSFPDISGILLTGGLQPSASVHRLIEGWTGVPTPILSVSTNTYRTTQLLSELYGRIDPDDQRKTASALGTFEASVKTDELRHRLITSKSSKVTPKMFEYKLVQKAKANKQTIVLPEGTSERVLRAADILTRRGVADIVLLGKADEVAGKISQLGLEMNDVRILDPESAPQFDDYCETYFKLREHKGIRMSDARDRMLDPTYFASMMVQKGDADGMVSGSITTTAQTIRPAFEFIKTKPGASIVSSVFLMCLKDKVLVFGDCAVNPNPNAEQLAEIALNSAETAKIFGVEPRVALMSYSTGQSGKGADVEKVKEAVKIAKERNPELKLEGPIQYDAAIDPSVAKTKLPDSEVAGQATVFIFPDLNTGNNTYKAVQRSAEQSVAIGPVLQGLNKPVNDLSRGCTVPDIVNTVAITAIQAAAEKGQI

SEQ ID NO: 1806 - protein, 702 aa, Desulfohalobium retbaense DSM 5692
MAKNLYITTTEPRSGKSAIALGLMQLLMRDIRKVGFFRPIINTPSRDVRDHDINLIHSQFHLDMEYEESFAFTLQEAKDLLNNGKQDLLFETILKKYKEVEAKCDFVLCEGSDFQDTASAFEFDINAEIAANLGAPLLLVANGHRKTAQEVVSATQLALDSYEDKSVDILATVINRAAPEIDQSIARELSCTSCKDKSMLVYVIPEEDTLGKPTMSDVKKWINATVLYGEDRMENLISDNVVAAMQIGNFLDYITQGSLVITPGDRSDIILSSLASRLSSNFPDISGILLTGGIYPSKNVLKLIDGWTGVPMPVMLAKDHTYRTTRTVDALYGKIEPDNPKKIATALGVFEANVNTEELRLRLVETKSTKVTPRMFEYSLVEKAKANKQRIVLPEGTSDRVLRGADIILRRGVCDVTILGDPAKLKAKASELGLDLDGAQLINPIDAENLDDYAAAYFELRKHKGVTEEQAKDAMSDPTYYATMMVHKGDADGMVSGSITTTQQTILPAFQIIKTKPGASIVSSVFLMCLRDRVLVYGDCAVNPNPNAQQLAEIALSSAETARIFGVDPKVAMLSYSTGASGKGDEVEKVREATALAKERRPDLLLEGPLQYDAAIDPDVAKTKLPDSNVAGKATVFIFPDLNTGNNTYKAVQRSAQAVAIGPVLQGLNKPVNDLSRGCTITDIVNTVAITAIQAQAEKGLI

SEQ ID NO: 1807 - protein, 700 aa, Desulfomicrobium baculatum DSM 4028
MARNLYITATESRSGKSAIVLGVMQMLLRDIRRVGFFRPIINDVPDRKDHDIDLVLSQFYLGLQYSETYALTMQQAKELVNAGQHSLLIEKVINKYKELESKCDFVLLEGTDFEGTSPAFEFDINADIAANLGSPLLVISNACQKTEHEIISSTKLAVESFADKAVDILGVVINRTDVPDREALRIALKKSMNKPDTLLYIIPEVAILGKPTVGDVMKWVGAEVLYGKENLGAQVDDIVVAAMQIENFLNYIERGSLVVTPGDRSDIVVSSLASRQSSSYPDISGILLTGGIRPGKSVDRLIEGWTGVPVPVLLGKEATFQTARRLYNMYGKIEPGDQKKIASALGVFEENVATDELRQRLDTRKSTKVTPQMFEYGLIEKAKKHKQHIVLPEGGDDRILRAADILLRRGVVDLTILGDPKSIASMTSQLGLSLTGVNIVDPGVSPDYNDYVSTFMDLRKKKGVSKEVACDCMVDPTYFGTMMVYKGQADGMVSGAINTTAHTIRPAFQIIKTKPGASIVSSVFLMCLKDRVLVFGDCAVNPNPTAPQLAEIALNSAETARIFGVEPRVAMLSYSTGDSGAGGDVDVVIEATRIAREKAPSLLLEGPLQYDAAIDPEVGAKKLPGSQVAGRATVFIFPDLNTGNNTYKAVQRAANAVAIGPVLQGLNKPVNDLSRGCSVADIVNTVAITAIQAQAEKGLI

SEQ ID NO: 1808 - protein, 698 aa, Desulfonatronospira thiodismutans ASO3-1
MAKNLFVINTEPRSGKSAVCLGLMQMLRRNIRKVGFFRPIINTLQEGKVDHDIHLILSRFQLQQSYEDAYAYTLEEARDLINQGKHYVLMENIMSKYKALEKNCDFVLCEGTDFVGTDSAFEYDINAEIAANLGSPVILITNAQKKNPKQVVSQTQMAIDSFIEKGVDILATIINRSRVEDKYEILSGLRCKFRDEADCLSFLIPEVESLGRPTMHDVHKWLGGEVISGQDFLDVQVDDYLVAAMQVNNFLDYVTQNSLVITPGDRSDILLGCFSTRQSRAYPEVAGIVLTGGMHPPASMTRLLEGWAGVPLPILAVEGHTFKVARILTELYGRIDPEDEKKVATALGSFEEHVDTEALLSRLEAKRSTRVTPIMFEFSLLEKAKADKKHIVLPEGSSDRVLQAADILLRRGIVDLTILGEPDRMRTRASQMGLHLEKALLLDPTSSKEFEDYADTYLELRKAKGVTPEVARDTMSEPTYFGTMMVYKEHAHGMVSGSITTTQQTIRPALQFIRTKPGISLVSSVFFMCLPDRVLVFGDCAVNPNPSAEQLAEIAISSSETAVQFGVEPRVAMLSYSTGESGAGEDVKKVRQATEIARSKAPELLLEGPIQYDAAYDPEVARAKMPDSKVAGRATVYIFPDLNTGNNTYKAVQRAANAVAIGPVLQGLNKPVNDLSRGCTVADILNTVAITAIQAQHA

SEQ ID NO: 1809 - protein, 701 aa, Desulfovibrio salexigens DSM 2638
MSKSLYIAATEARSGKSAIVLGVMQLLLTHLRKVAIFRPIIHDNFHERDHDIDLILRHFKLPQDYKTTYAYTQSEATRLLNDGKHSLLMENILDRFKKLEEDYDFVLCEGTDYLGGEAAVEFEINLDVASNLGCPVLAVLNAMDSYEDEICDLANRTVAMFEEKGLDVISVMVNRAAKEFSPDLGERLRRCLKSESSPLVYVLPDDKRLGNPTMSDVVKWLDCRVLYGRDRLDTPIDNYVVAAMQIENFLKYVNDGSLIITPGDRSDIILASLSSRLSDAYPNVSGILLTGGIKPAMTVHHLIEGWKGVPLPILVAPGHTHKTAQILRGLHGKIDPENQVKVLSAMGLFETCVDSHELQQKLVSSRSTRITPYMFEHTLLHKARENKQHIVLPEGKEERILRAADILRRRDVVNLTLLGNEQEIKKTASDIGISLNGIEIVDPVKSEYFDRFVDEYFELRKHKCIVKDDARDRMSDPTYFGTMMVYTGVADGMVSGSITTTAQTIRPAFEFIKTKPGFSIVSSVFLMCQNDRVMAYGDCAVNPNPNAQELAEIAISSAHTAKIFGIEPKVAMLSYSTGESGKGQSVDKVKEATELVRKIAPEIAVEGPLQFDAAVDPDVAAELMPDSDVAGQATVLIFPDLNTGNNTYKAVQRSQPESVAIGPVLQGLKKPVNDLSRGCTVRDVVNTVAITAIQAIAEKGI

SEQ ID NO: 1810 - protein, 700 aa, Desulfovibrio piger ATCC 29098
MHRALYLTATGPRTGKRAIALGTMSILSRNMQDVAIFRPIINEPQLDDRAPDINLLLEHFKLKQDYCDTFAYTYQEVRTIINQGDRNLVIENIIQKFKELQSRHDFVLCVGTDFLGKDPVFEFELNAEIASNLGCPVMLITSGEGKSAEEVRDSLLVTRDSMAPYSLDVIATIVNRSSLTRAEADDLSDIFAADDKPGLVYAIPDEPALGRATMRDLQKGLNAEVLSGEAHLDALVGDYLIAAMHVDNFLGYLAKDQLIVTPGDRTDILLASIASRLSSSKPDIAGVLLTGGIRPSAEVSSLIEGWTGAPLPVLLTDQHTSKAFMSLQEIYGLIEPTDTRKINTVLGLYDHYVNGKEISARLNMTKPGRMTPMMFELNLIERAKANKMRIVLAEGEEPRILQATDILLRREVADIILLGNEDKINKLARELHLDISKATIIDPATSPKFEDYAATYAELRKAKGVTIERARDVMSDATYYATMMVKKDDADGMVSGAVNTTAHTIRPAFEFIKTKPGYSVVSSVFLMCLKDRVLVFGDCAVNPNPTSQQLAEIAVASADTAKVFGIDPRVAMLSYSTGTSGKGADVDVVVEATALAKEKAPELSLEGPLQYDAAIDPTVAKTKLPNSKVAGKATVFIFPDLNTGNNTYKAVQRAAEAVAIGPVLQGLNKPVNDLSRGCTVPDIVNTVAITAIQAAAEKQK

SEQ ID NO: 1811 - protein, 702 aa, Desulfovibrio desulfuricans subsp. desulfuricans str. ATCC 27774
MYNGLYITATGPMTGKSAIALGAMQLLSRSMRKVAFFRPIINEPLWDDRDPDINLMLEYFKINSDYADTFAYTQREARQIINQGSRNLLMENIIQKYKKLLETYDFVLCVGTDFLGKDPVFEFELNAEIAANLGTPVILVTSGQKSTAEDIRESLQITMDSLAPYSLDVVATIINRRNLTQTELDELRTHFSTEDRKALIYSVPNEPTIGQPTMGDVKKGLDAEVLFGEDRLDALVDDYLIAAMHVNNVLHYIAKDQLIVTPGDRADVLLAAIASRLSSSTPDIAGVLLTGGIRPAKEVCEFIQGWTASPLPILLTKGHTYNTMLALQELIAPIEPGNLRKINTVLGLFEQHVNGKDIASRIVSKRSSRITPMMFEFELIERAKANKMRIVLAEGTEERILRATDILLRRGVADITLLGDVDEIRTKASTLGLDLEKATLIDPVNSPKFDEYANTYYELRKKKGITPEQARDTMADSTYYATMMVKQDDADGMVSGAVNTTAHTIRPAFEFVKTKPGFSVVSSVFLMCLKDRVLVFGDCAVNPNPTAQQLAEIAIASAHTAEVFGIEPRVAMLSYSTGTSGKGADVDIVVEATKIAKEMAPGLALEGPLQYDAAIDPSVAKTKMPDSKVAGKATVFIFPDLNTGNNTYKAVQRAAGAVAIGPVLQGLNKPVNDLSRGCTVPDIVNTVAITAVQAAAEKAAGR

SEQ ID NO: 1812 - protein, 710 aa, Desulfotalea psychrophila LSv54
MTQNLYITATEERSGKSVIVLGVMQMLMKEVRNVAFFRPIISDTEPGDDDPDINLVLDYFDLDIPYEDTYGCTLSKAYELINSGKEDQLHDLILKKYKKLEADHDFILCEGTDFRGSDTSFEAEINADIAANLGAPLLLVLSGRKKIEKEIMQATQLSIDTMLEKGSSFAACIINRAAETITPETFHKLQAKNRALSRIPFYVMPENSNLASPSVMDVKKWLDASVMHGSEKLAGLVENYVVAAMQIGNFLDHIKPGSCVITPGDRSDIILASLASKASSTYPDISGIVLTGDMKPAESVQKLIEGWQGTPTPILSVATNTYQTIMRLNELYSHIQASDSQRIATALGTFSKHVDTKELTEHLISSIPTTITPKMFEYALMEKASQDKQRIVLPEGTCERILRAADILLRRGVANLTLLGPADEVKSRAAACGMDTRWVEIIDPQNTNLLAPFVDEYMKARAHKGMIEDIARDRMTDPTYFGTMMVHTGYADGMVSGAENTTAHTIRPAFEFIKTKPGISTVSSVFLMCLSDRVLVYGDCAVNPNPTAKQLAEIALSSAETARLFGIEPRVAMLSYSTGSSGKGEDVERVIEATKIAQALIIERKLDINLEGPIQYDAAIDPDVARTKLPNSLVAGKATVFTFPDLNTGNNTYKAVQRAAGAVAIGPILQGLNKPVNDLSRGCTVDDIVNTVAITAIQAQEEKRLFALKK

SEQ ID NO: 1813 - protein, 706 aa, Lawsonia intracellularis PHE/MN1-00
MANKLYITATEKRSGKSAVTLGMMQLLMRHIRSVAFFRPIIANIDPNKKDHDINLILTTFNIAMPYEDTYACSFKEARTLIAEQKSPVLIEKIIQKYKHLEDNYDFILCEGTDYLSNDSAFEFELNIDIAANLNMPLAVIVNGKNKSIEDLISSTVTSSELIFDKGQDIACLFINKTTLAIPELENCKKAISTAIGSQVPIAMFPNNSVLSRPTVSDIKRWMKAEVIYGEECLNNSVEDYIITTMQPNNFLDQLQQGLLIITSADRSDIVLASLASRLSMTYPDIAGIILTGKFELSSHITRLINGWQSVPVPILTVSQNSYQAIMTLSELYGKINVSDTRKIHIALAIFEQHADSNAITQRVIERTSDKVSPKMFEFKLIEQARRHKMRIVLPEGTEDRILKAAEVLSQREVADITLLGDIPTIHKKISDLGLSLHNVQLIQPNQNHALFENYVQTYYELRKHKGITLDDARDWMNDTTYFGTMMVYKNDVDGMVSGATNTTAHTVRPAFEIIKTKPGASIVSSVFLMCMKDRILVFGDCAVNPNPTAEQLADIAISSAQTAHVFGIPVRVAMLSYSTGTSGKGIDVDIVSEATKIAHEKAPHLILDGPIQYDAAIDPDVAKTKAPTSVVAGKATVFIFPDLNTGNNTYKAVQRAAGAIAIGPILQGLKKPVNDLSRGCTVTDIINTVTITAIQAQAEQGLITID

SEQ ID NO: 1814 - protein, 676 aa, Lyngbya sp. PCC 8106
MELLSKRIGRLGVFRPIIHRRDQPDPDIELIRTRYQLDFPYESLYALNHEQAQHIVAEGHYDQLLKVILEKYKTLEQQCDFIVCEGADTVDVTSAFDFDLNVQVANDLGSAIIIVANGQEKTPEEVVDGVRSEREAFIEEGCTIAATIVNRVLPENVSTITEKFQNCWSSEDPVFVLPEEEILWKPTIGEVAQKINAKFIHGDGDQLNREVHDCKVAAMQVPHFLEHIDEGSLIVTPGDRADILLSCLVATLSDNYPNIAGIILTGNIQIPLSIYKLIDGFSQWSVPIMMVKEDTFETATKISQVRARITADNPRKIATALGIFESYVQGSKIEERISVSRSHRRTPLMFEYELIERARKNKKHIVLPEGNEERILQASEILLRRGVVDITLLGQELEIRQKIAALGLSLDGVNIVDPNTSDWYKDYAETYFELRKHKGISRDCAADVMHDNSYFATMMVYKGVADGMVSGAVHTTAHTIRPALEFIKTQPGCSIVSSVFLMSLEDRVLVYGDCAVNPNPNPQQLADIAISSALTAKMFGIEPLVAMLSYSTGESGKGEDVDKVREATQIAQQLRPDLKLEGPIQYDAAVDESVAKTKLPGSEVAGHATVFIFPDLNTGNNTYKAVQRSANAVAIGPVLQGLKKPVNDLSRGCTITDIVNTVAITAIQAQSQGINY

SEQ ID NO: 1815 - protein, 702 aa, Arthrospira maxima CS-328
MAENLYIATIEPGSGKSLVVLGIIELLSKRIQKLGFFRPIIRSHTTPDRDIQLVRSRLHQALPYESYYALTHEEAQNLIGEGRYDEVIKQVIEKYKAVEQDCDFVVCEGTDFTDIASAFEFDFNVRFANHLGCPILIVASGSGKTPNQLMSALLAEREAFIEEGCAIAATVVNRVDNHNVPGIMEQLTTLWKFPDPLFVIPEEPILAKPTVAEIAQKLGGQQIYGPSDDRLNREVFDLRVAAMQVPNFLKYLKEGSLIITPGDRADIILACAVAATSENYPNIAGIILSGGLELPATIQSLIDGCPHWAVPMITVKTDTYETAMNVDRVHGAITPDNDRKIASALGLFETHVNLGQIEERIQVSRPSRMTPIMFEYQLIQRAKANRQHIVLPEGREDRILQAAEILWRRGVADITLLGSEAEIRGRIAALGLNLSQVQIIDPARSPWYEDYAETYFNLRKHKGIAKDGAYDVMLDVSYFGTMMVYKGHADGMVSGAVHTTGHTIRPALEFIRTIPGTSIVSSVFLMGLEDRILVYGDCAVNPNPNPQQLADIAISSALTAQMFGIEPRVAMLSYSTGESGQGEDVEKVKQATIIARQLRPDLKIEGPIQYDAAIDESVAKTKLPDSQVAGRATVFIFPDLNTGNNTYKAVQRSANAVAIGPILQGLKKPVNDLSRGCTVTDIVNTVAITAIQANLGTHFHSH

SEQ ID NO: 1816 - protein, 699 aa, Syntrophobacter fumaroxidans MPOB
MSKGIYITGTGPGSGKSLIVLGMMELLAQHGRKLGFFRPVAVEGGGVDRLAALVTSRYAITAPGESMFGASYASARDLIAGDKMDELQSRIIEKYEALERQCDFVVCVGTDYRAVHTALEFEYNVEVARNLGTPLMPIVAGRGRTPGEIVDSVRILAEFLEARKCDLVSVFVNRVAPGHVKEAATRLEENAPAGIPVFVLPDHPMLDKPTVGEIMRALGAGMVHGDANRLDREVTGYRVAAMELPNFLDHLVEGCMVITPGDRSDILIGTLAADAATSYPGIAGVVLTGGFKPAPQVQRLFEGLRRSPVPILHVDADTFETVTEVNAVPAGLSPENQRKIAGALGVFESNVDVSRLEGRIAVMRSSRVTPLMFQHDLLSGARAKRRHIVLPEGTEKRILRAAEILQLRDAVDITLLGSPKEVGEKITSLGLSLPGVKIIDPMTSELREDFGRTYFELRQHKGISLQMALDAMSDVSYFGTMMVCRGIADGMVSGAVHSTQHTIRPALEIIRTRPGCPIVSSVFFMCLSDRVLVYGDCAVNPDPDAEQLAHIAISSASTARNFGIEPRVAMLSYSTGESGKGADVEKVKEATRLARRLCPDLKLEGPVQYDAAVDPDVARVKLPESEVAGRATVFIFPDLNAGNNAYKAVQRTANAVAIGPVLQGLNKPVNDLSRGCTVTDIVNTVAITAIQAQMEGDAT

SEQ ID NO: 1817 - protein, 706 aa, Allochromatium vinosum DSM 180
MQSIYIAGAGAGSGKSVVVLGFMEMLSAIGRRIGFFRPFAPRGAELDNLTALIRERYALPFPPEMLYGCTVETARQFIGSGRYDELLKLIMNKFKMLEEQCDLVVCAGTDYNGLIPSLEFGFNVDLANNFGCSLVAVVKGFGRTPQEAWDALHITHELMRERGGDFLATVVNGVAPQDLETVRGRVQHLLTETETIYVLPEQQALGMPTVGEIRQALGAECLYGEGDALHQVVTNYKIAAMEIPDFLRYVEDGCLIITPGDRSDIILASLAADASSAFPRVAGLLLTGGLRPADKVRDLIEGLRRTKVAILQVPTDTFTTAMHVSRIESSLLPGDDRKIAAALGVFEANVDLDELRGRIAVHHTERVTPLMFEYELIRRAKSRRQRIVLPEGGDERILRAAEILSLRQVADLILLGNPERIQRRAAELGLDLGDIRIIDPIDSPDRDRYARTYYELRKHKGISEQMAHDVLADVSYFGTLMVYHGDADGMVSGATHTTQHTIRPSFETVKTKPGVKLVSSVFFMCLPDQVLVYGDCAVNPNPDSEELADIAISSAQTATAFGIEPRIAMLSYSSGSSGKGEDVDRVREAVRLVRERRPDLKVEGPIQYDAAVDIEVGRSKMPDSEVAGHATVLIFPDLNTGNNTYKAVQRSAGAVAIGPVLQGLNKPVNDLSRGCTVTDIVNTVAITAIQAQGESIAAAANEECAR

SEQ ID NO: 1818 - protein, 699 aa, Rhodopirellula baltica SH 1
MIQRSVYIGTNGNATGKRMVALGMMELAARRFGRVAFFRPVVHVGPNEDQSIRMMRSRYGIVTPADEMFGVTRAQARQMLADDRYSNLIQLIQQRFKSLEAKADFVVVEGTSYQGLAPELEFELNADIAANIGSRVLSVYAMGDRSVDECVQSVLIGNESFVDRGAQLIATIINKVPDDQSTALNAAIKTSKLDSKAPLYFLPDEPLLRQPTVREIQSGIGAKLVSGDESSLDREVAVRKVAAMQLPGFLERLSNAALVMTPGDRSDILVGCVLACSQPDGPSPAAVVLTGGILPPPSIRRLVENANALPILVAIEDTYTVASKAAEVRAEIGDHSPRKIESAIGVFERHVDTDSLADRLQAPIVPRITPMLFEHSLIQRARQQRVKIVLPEATEPRILQAVDVLRRRDVTDVVLLGDPNLIAAAAARAGVMLPNDGLEIIDPATSPLRNSFASEYYQLRKHKGVTTDIAHDRMIDVTYFGTMLVHRGLAGGLVSGAVHTTANTIRPAFEFIRTRPDVNVVSSVFLMCLKNGVLVYGDCAVIPNPTAEQLTEIAISSAETAVQFGIEPRIAMLSYSTGESGHGEDVDKVREATAMVRKRRPDLLVEGPLQYDAAVDPDVAATKMPGNPVAGQATVLVFPDLNTGNNLYKAVQRSAGAIAIGPVLQGLNKPVNDLSRGCTVTDIVNTVAITAIQAQTVAS

SEQ ID NO: 1819 - protein, 692 aa, Sulfurimonas denitrificans DSM 1251
MNVQSLYILALEKNVGSLFITMGIMEILKRNINKVAFFRPIITDKNVVDKDIEFISQRYNLEMSYEECYGFDLSEVDAIIASSGVDELIMRVVEKFKKLQERYEFILCEGIARSLFTSNSNHNLNALLAQNFGSSIITIFSAKEHSPLEVYESIAIEKQNLLSLDIPCFNMFVSRVDEQSYLDLKRVLKDYSSNISFLKELPELDVLTLEDVVETLDVKKIVFSQNDNARAVRGFFVASLGVDEFLDEIKDDDLVIVDAKRSDIILALIASFYSKEYPKISAALFVGDSELTQSLKKLILGLHEYKIPFLSIKSNTFESVKKLLHVYPRLRVKSERKIALALGLFSASVDITAFEQKIKVQNSDVMTPIMFQYKLFEMARKKKKNIVLPESSDERILRAAEIVLRRDVADITLLGKEEEIREHCQKLGLDISKATIIDHKKSKRLEEFSNLFYEMRKAKGITLKAARDAMMHRNYFATMMVHVGLADGMVSGAIHSTADTLRPALQIIKTTSDVEIVSSIFFMCLKTKILIYGDCALNQNPNAKELAQIAISSAKTAELFDITPKVAMLSYSTGESGSGADVDKVREATMIVKALRSDLEIDGPLQYDAAVDKSVASMKLPNSKVAGEANVFIFPDLNTGNNTYKAVERSSGALAIGPILQGLKKPVNDLSRGCSEADVLNTILITAIQANM

SEQ ID NO: 1820 - protein, 693 aa, Campylobacterales bacterium GD 1
MKIKSLYISAQEKNAGTLFISMGMMEILKRNMPHVAFFRPVIYSKHIEDGDINFMLNRYNLEMDYKDCYGFDIEYVENMIANNKTDQLMNEFITKFKKLEDKYDFVLVEGIRHSFLTSTINFDLNIKIAQNFGSPIINIVNAKNKTIADIHDDILIENENSTFQGCTHFATFINRLDDKQDEALKKKLNDYPLKIYFLKEVDELGMLSIADVIDSLDAIPIFLQPKDITRIVRGIKVAALTLNNFLDHVEEDDLVVVPADRSDIILGLFGALYSKNYPNISGIVFPFGMEAHPNIKKLIDGLNSFSIPILSVDDDTYMTANKLSKAQARLRVTSERKIALALGLFNSSVDIEAIEKKIATVVSTVLTPMMFEYKLFERARLNKKRIVLPESNDERILRAAEIILRREVADITLLGNSEKITETYLRLGLDLSKATIIDHHTSNLRKEFAEIFYEMRKEKGLTLQAAEDAMTHGNYFATMMVHLGHVDGMVSGAIGSTGETIRPALQIIKTKPNISIVSSVFFMCLKKEVLVYGDCAVNQDPNAEELAQIAISSAETAQAFGLEAKIAMLSYSTGESGSGIDVDKVREATKIVKNKKPNLLIDGPIQYDAAVNKKVASTKLPDSKVAGEATVLIFPDLNTGNNTYKAVQRSSGAVAIGPILQGLKKPINDLSRGCSVSDIVNTVAITAIQAGQD

SEQ ID NO: 1821 - protein, 702 aa, Sulfurospirillum deleyianum DSM 6946
MQTKSLYISSLEPAAGSLIVTMGIMELLKGRLGRVAFFRPVIVNVGEPDQDISFMLEHYALKMAYDDTYGYTVHEVESLIAENKYNEVLETLIEKFKTLENQYDFVLVEGLNQANFSNTLDFDINLSIAKNLSSPFISVLKGKNKSVKEVVDEIHIEAEAIRAAGCQHFATFVNRLGKAESEALQELAASVALQNSPIYFLPEVPELDTPTVAEIQKKLGCMRIYGEEKDLRRVVKQSKIAAMRLENFLEHIEEGDLIITPGDRSDVILGCLSAALSKNYPTISGMLLTGGLLPDKAINKLFLGFNDFSIPVLSVESDTYHTAVNVAQVPATITAQSIRKIALAMGLFSSNVNLKEIETMINAESSLSSITPVMFEYALFERARSDRKKIVLPESNDERILRATEILLRRNVADIILLGNPEEVLRKSASLGLDIGKATIIDPANSPLMDEFVRTFYEMRKSKGLSLDVARDSMMMTNYFATMMVYSGHADGMVSGAIHTTQETIRPALQIIKTKPGISIVSSLFFMCLETRVLVYGDCAVNQDPNAEELAQIAISSADTAKMFGIEPKIAMLSYSTGDSGKGEEVEKVRLATKIVKETRPDLLVEGPIQYDAAIDPTVAKTKLPNSQVAGEATIFIFPDLNTGNNTYKAVQRSSGAVAIGPVLQGLRKPVNDLSRGCLVPDIVNTVAITAIQAQTNDGVSN

SEQ ID NO: 1822 - protein, 699 aa, Sulfurovum sp. NBC37-1
MQHASIYIASTEAQSGTMIIAIGFMEMLKGRYTNVAFFRPIIPDQKEDETHIGFMREHFGLKIPYEACYGFTESEVIQAFADDLEEVLFEALMAKVDKLHREYDFVMIDGYPRNRFASTFDFDINLKIAKNLGTAFIPVISAWKKNSDEIINEIQIITEAIKTEGCSELATFVNRCDDECMKTVLQEVENLGKEKQVYILPEVKEVDTPTLRQIVKTLDAKMILGEGEQLNHLVRSTKIVAMGVENYLLRIEDEHLIIVPADRNDIILASLLSYAAKNHPNIVGMILSGGIEPSNTIIDLIKDFSASAPIPIFTIHSDSYETAIAVAKVQAKISPEDTDKITLVKVLFDKYVDKERIAQKFRQSQNNVMTPLMFQYSLFEQARSLRKRILLPESDDERILKATAILLQRDIVDIILLGEEESVHHRAAQLRVDISKAQIMEPAKSGLIEKFSRQFQALRASKGLTLDTARDAMEHKNYFATMMLYNGMADGMVSGATHTTADTIRPALQIIKTKPGISIVSSIFFMLLDTKVLVYGDCAVNLDPNAEQLAHIAISSADTAAQFGIEPRVAMLSYSTGDSGSGPDVEKVREATKIAQKMRPDLLIEGPIQYDAAIDMKVARKKLPDSKVAGRATVFVFPDLNTGNNTYKAVQRSTGAIAIGPILQGLKLPVNDLSRGCLVDDIVNTVAITAVQAQHLDRS

SEQ ID NO: 1823 - protein, 692 aa, Mycobacterium vanbaalenii PYR-1
MPDATTGTTSSIYLASPEGDTGKSTIALGILHRLSATAARVGVFRPITRMGESRDYILELLLDHTTAGLPYEDCVGVGYQQLHDDPDAALAEIVDRFHRVADRCDAVLVVGSDYTDVAAPSELSVNARIAANLGAPVVLAVKGKGRTPEQILQVVDVCINEIAAQHAHTAAVVVNRCDPILLVDVAEALASIGPQSYVLPEEPLLVAPSVSELRSAVEGHQVQGDPALLDREVLDVLVAGMTAEHVLERLTEGVAVVTPGDRSDVVLAVLSAHAAAGFPSLSAVILNGGLTLHPAIGSLVAGLGLRLPVIETRLGTFETASRIAATRGRVTSKSHRKIDTALTLMDTYVDTAELLAHLAIPIPTVVTPQMFTHQLIEQARSDRKRIVLPEGNDDRILKAAGRLLHRGVADLTILGEEAQVRARAAELGLDLSTAVVLDPQTSELCDRFAEQYAKLRAHKGVTVEQAHEIIHDVSYFGTMLVHNDLVDGMVSGACHTTAHTIRPALEIIRTAPGVSTVSSIFLMCLAHEVLAYGDCAIVPDPTAEQLADIAISSARTAAQFGIEPKVAMLSYSTGTSGTGADVDKVRKATELVRSRAPELLVEGPIQYDAAVEPSVAMTKMPDSRVAGHATVLIFPDLNTGNNTYKAVQRSAGAIAIGPVLQGLNKPVNDLSRGALVEDIVNTVAITAIQAQG

SEQ ID NO: 1824 - protein, 707 aa, Mycobacterium gilvum PYR-GCK
MRAGAQFGRLWDVPDAAKTTISAIYVASPEGDTGKSTIALGILHRLAATVARVGVFRPITRGDGAPRDYILELLLDQTTADLPYEDCVGVTYHQLHEDPEAALAEIVDRFHAVADRCDAVLVVGSDYTDVAAPSELSVNARIAANLGAPVVLAVKAKGRNPEQVAQVVELCVDEIAAQHAHTAAVVANRCDPAQLVEVGEALTKIEPQSYVLPEEPLLVAPSVAELQAAVEGAVVQGDPALLHREVLDVLVAGMTAEHVLERLTEGGVVITPGDRSDVVLAVLSAHAAEGFPSLSGVILNGGLPLHPAIDGLVAGLGQRLPIVETRFGTFETASRVAATRGRVTSQSHRKIDTALTLMDTYVDTAELLAHLALPIPSVVTPQMFTHQLLERASADRQRIVLPEGNDDRILRAAGRLLQRSVADLTILGDESQVRARAAELGVDLSHAAVLDPKTSELCDRFAEQYAELRQHKGVTLDRAREVIHDVSYFGTMLVHNDMVDGMVSGARHTTAHTIRPAFEIIRTAPGVSTVSSIFLMCLADEVLAYGDCAIVPDPTAEQLADIAISSARTAAQFGIEPRVAMLSYSTGTSGTGADVDKVRQATELVRSREPDLPVEGPIQYDAAVEPSVAQTKMPDSAVAGRATVLIFPDLNTGNNTYKAVQRSAGAIAIGPVLQGLNKPVNDLSRGALVEDIVNTVAITAIQAQGVH

SEQ ID NO: 1825 - protein, 704 aa, Mycobacterium sp. MCS
MSLMRQAVRVPDQTDSRVSAIYVASPEGDTGKSTIALGLLDRLTATAPRVGVFRPITRSGPARDYILELLLAHSTAGLTYEDSVGVTYHQLHEDPDSALADIVDRFHRVADRCDVVLIVGSDYTDVASPSELSMNARIAANLGAPVVLAVKARGRTPDDVVQVVEVCLDEIAAQHAYTAAVVANRCDPDQLTEVREALKRDGAPQVYVLPEEPLLVAPSVAELRDAVDGSMVSGDESLLDREALDVLVAGMTAEHVLERLTEGVTVVTPGDRSDVVLAVVSAHAAEGFPSLSSIILNGGLELHPSIAKLVAGLGLRLPIVATGYGTFETASRVAGTRGRVTAASVRKIDTALTLMETHVDTAELLSRLAIPIPTVVTPQMFTYQLLDQARSDRKRIVLPEGDDDRILKAAGRLLQRGVADLTILGEEGPVRARAAELGVDLAAATVLDPRTSELCDQFAEQYAELRRHKGVTVEQAREIIHDVSYFGTMLVHNDMVDGMVSGAAHTTAHTVRPAFEIIKTLPDVSTVSSIFLMCLADRVLAYGDCAIVPDPTAEQLADIAISSARTAAQFGIEPRVAMLSYSTGTSGTGADVEKVREATDLVHKREPDLLVEGPIQYDAAVEPSVAKTKMPDSPVAGRATVLIFPDLNTGNNTYKAVQRSAGAIAIGPVLQGLNKPVNDLSRGALVEDIVNTVAITAIQAQGDR

SEQ ID NO: 1826 - protein, 692 aa, Mycobacterium smegmatis str. MC2 155
MPEGEAATAIYIASPEGDTGKSTIALGILHRLAATVPKVGVFRPITRLGEDRDYILELLLAGTTAGLPYEDCVGVSYQQVHEDPDAAIAEIVDRYHRVADQCDAVLIVGSDYTDIATPSELSMNARIAVNLGAPVVLAVKAADRTPDEVVHVVEVCLAELAGQHAHTSAVVANRCDPAQLTAVSEALRPLGPPAYVLPEEPLLVAPSVAELQKAVDGTVVAGDPALLSREALGVLVAGMTAEHVLERLTEGVAVVTPGDRSDVVLAVVSAHAAEGFPSLSTIILNGGLDLHPAIAKLVDGLGLKLPIIATPYGTFETASRVASARGRVTSTSQRKIDTALQIMERHVDIDDLLARLRLPIPEVTTPQMFTYQLLDRARADRKRIVLPEGDDDRILKAAGRLLRRGVADLTILGEENQIRSRGAELGVDLSAATVLDPRTSDLCEAFAQQYAELRKHKGITLDQAREIIVDVSYFGTMLVHNDMVDGMVSGAAHTTAHTVRPAFEIIKTLPDVSTVSSIFLMCLEDRVLAYGDCAIVPDPTAEQLADIAISSARTAAQFGIEPRVAMLSYSTGTSGTGADVEKVKAATDLVRERDKTLLVEGPIQYDAAVEPSVAKTKMPDSEVAGRATVLIFPDLNTGNNTYKAVQRSAGAIAIGPVLQGLNKPVNDLSRGALVEDIVNTVAITAIQAQGRS

SEQ ID NO: 1827 - protein, 693 aa, Mycobacterium abscessus
MTQPKASSIYIASPEGDTGKSTVALGVMHRLAASVARVGVFRPIARSGESVDYILELLLEQSTADIAYEDCLGVSYHDVHQDPDAAIAQIVDRYHAVAERCDAVVIVGSDYTDVASPSELGTNARIAVNLGAPVLLTIKGFDRTPDEVAALAEVCLGELKAQRAHTAAIVANRCNPGQLDEVRQALARFDKPAWVLPEVPLLVSPSVEELMKAVKGSLVSGDEALLSREATSFMVAGMTAEHCLERLKEGQAVIFPADRSDVLLAVASAHVAEGFPSLSAIILNGGLKLHPRIADLVDGIGLRLPIIETDSGTFETASAAAHARGRVTVASARKIDTALALMDRYVDGADLVAQLAIPIPSVTTPQMFEYQLLDRARDNRKRIVLPEGDDDRILKAAGRLLQRQVADLTILGEEAEIRSRAAELGVDISNALVVSPKTSDLAEKFADQYFELRKHKGMTPDRAREIMRNVSYFGTMLVYNDIVDGMVSGAAHTTAHTIRPAFEVIRTTSGVSTVSSIFLMCLADRVLAYGDCAIVPDPTSEQLADIAISSARTAAQFGIDPRVAMLSYSTGSSGSGADVEKVRIATELVRSRQPELLVEGPIQYDAAVEPSVAATKMPDSPVAGRATVLIFPDLNTGNNTYKAVQRSAGAVAIGPVLQGLRKPINDLSRGALVEDIVNTVAITAIQAQERKQS

SEQ ID NO: 1828 - protein, 696 aa, Mycobacterium kansasii ATCC 12478
MSSSSPGTTAIYIAAPEPASGKATIALGILHRLTATVAKVGVFRPLTRASGARDYLLELLLEHTTAGLPYEQCVGVTYQYLHADTDTAITDIVAAYHAMAHKCDAVVIVGSDYTDVATPTELSVNARIAVNLGVPVLLAVNAKGRTADQVVSVVGVCLAELSAHHAHTAAVVANRCEPAELAAIREALRIVGPPSYALPEEPLLSAPTVAELERAVDGTAISGEAPLRNREVMDVLVAGMTADHVLERLGEGMAVITPGDRSDVVLAVASAHAAEGFPSLSCIVLNGGFDLHPSIAALVSGLRLRLPIIATTLGTYETASAAAAARGRLTATSQRKIDTALELMDRHVDTADLMTHLAIPIPTVTTPQMFTYGLQQRARSNRKHIVLPEGDDDRILKSAGRLLQRGIAELTILGDEARIRARAAELGVDLGQAKVLDPRTSPLCDHFAEQYAELRKSHGITAELAREIMCDVSYFGTMLVYNSHVDGMVSGAAHTTAHTVRPALEIIRTAPGISTVSSIFLMCLPDRVLAYGDCAIVPNPTPEQLADIAICSARTAAQFGIEPRVAMLSYSTGASGTGADVEKVREATELVRSREPQLLVEGPIQYDAAVDPAVAAAKMHDSPVAGRATVLIFPDLNTGNNTYKAVQRSAGAIAIGPVLQGLRKPVNDLSRGALIEDIVNTVAITAIQAQGIGDDR

SEQ ID NO: 1829 - protein, 694 aa, Mycobacterium marinum M
MSTGSGATGIYIAAPEPESGKSTIALGILHRLAATVAKVGVFRPITRRGERRDYILELLLEQTTAGLSYEQCVGVTYQQLHDDLEAAIADIVAAYHAMADACDAVVIVGSDYTDVTTPTELSVNARIAVNLGAPVLLAVSAKGRDADQVSGVVAVCLAELAAQHAHTAAVVANRCEPAQLAAVGDALRAFAPPSYVLPEEQLLSAPTVSELEKSVNGTPISGDASLWGREVTSLLVAGMTADHVLERLRDGMAVITPGDRSDVVLAVASAHAAEGFPSLSCIVLNGGFELHPSIASLVAGLRLRLPIIGTDLGTFDTASAAATARGRVKATSQRKIDTALGLMDRYVDIEDLLAKLAIPIPTVTTPQMFMYRVQQQARSDRQRIVLPEGEDDRILKSAGRLLQRNVADLTILGDEAEIRLRAAELGVSLDSATVIDPRTSSLCNEFADQYAQLRKAKGITHEQAREIMNDATYFGTMLVYNGMADGMVSGAAHTTAHTVRPALQIIRTVPGVSTVSSIFLMCLPDRVLAYGDCAIIPNPTVEELADIAVCSARTAAQFGVEPRVAMLSYSTGASGSGADVDKVRAATELVRERDPQLMVEGPIQYDAAVDLSVAATKMRDSAVAGRATVLIFPDLNTGNNTYKAVQRSAGAVAIGPVLQGLRKPVNDLSRGALVEDIVNTVAITAIQAQGVHER

SEQ ID NO: 1830 - protein, 690 aa, Mycobacterium tuberculosis H37Rv
MADSSAIYLAAPESQTGKSTIALGLLHRLTAMVAKVGVFRPITRLSAERDYILELLLAHTSAGLPYERCVGVTYQQLHADRDDAIAEIVDSYHAMADECDAVVVVGSDYTDVTSPTELSVNGRIAVNLGAPVLLTVRAKDRTPDQVASVVEVCLAELDTQRAHTAAVVANRCELSAIPAVTDALRRFTPPSYVVPEEPLLSAPTVAELTQAVNGAVVSGDVALREREVMGVLAAGMTADHVLERLTDGMAVITPGDRSDVVLAVASAHAAEGFPSLSCIVLNGGFQLHPAIAALVSGLRLRLPVIATALGTYDTASAAASARGLVTATSQRKIDTALELMDRHVDVAGLLAQLTIPIPTVTTPQMFTYRLLQQARSDLMRIVLPEGDDDRILKSAGRLLQRGIVDLTILGDEAKVRLRAAELGVDLDGATVIEPCASELHDQFADQYAQLRKAKGITVEHAREIMNDATYFGTMLVHNCHADGMVSGAAHTTAHTVRPALEIIKTVPGISTVSSIFLMCLPDRVLAYGDCAIIPNPTVEQLADIAICSARTAAQFGIEPRVAMLSYSTGDSGKGADVDKVRAATELVRAREPQLPVEGPIQYDAAVEPSVAATKLRDSPVAGRATVLIFPDLNTGNNTYKAVQRSAGAIAIGPVLQGLRKPVNDLSRGALVDDIVNTVAITAIQAQGVHE

SEQ ID NO: 1831 - protein, 695 aa, Mycobacterium avium subsp. paratuberculosis K-10
MADISAIYVAAPEPETGKSTVALGLLHRLTATVAKVGVFRPITRDGQDRDYILELLLSRTTAGLSYQQCVGVTYQQLHADGDAAIATIVDAYHAMAELCDVVVIVGSDYSELGQAIRPAELSTNARIAVNLGAPILLTVSGKGRTAAEVATVVQVCLAELDAQHAHTAAVVVNRCEPAELDAVAEALRGFPQRCYVLPDEPLLSAPTVAELEKAVAGSPVSGEESLREREVTGILVAGMTADHVLERLADGMAVITPGDRSDVVLAVASAHAAEGFPSLSCIVLNGGFALHPSIAALVAGLRLRLPIVATALGTYDTASAAAAARGRVTATSQRKIDTALELMDRHVDIADLLEQLAIPIPTVTTPQMFIHQLTLQARADRKHIVLPEGDDDRILRAAGRVLQRRVADLTILGDEARIRQRSGELGVDLSDVKVIDPRTSALRPEFAQQYAQLRKAKGVTVEQAREIMRDATYFGTMLVYTSQVDGMVSGAAHTTAHTVRPAFEIIKTVPDVSTVSSIFLMCLPDRVLAYGDCAIIPNPTPEQLADIAISSARTAAQFGIEPRVAMLSYSTGDSGTGADVEKVRTATQLVRQRNPDLPVEGPIQYDAAIEPSVAATKLRDSPVAGRATVLIFPDLNTGNNTYKAVQRSAGALAIGPVLQGLRKPVNDLSRGALVEDIVNTIAITAIQAQGLPGGR

SEQ ID NO: 1832 - protein, 719 aa, Mycobacterium intracellulare ATCC 13950
MVSGAATAIYIAAPEPETGKSTIALGLLHRLTATVAKVGVFRPITRSDGGDRQRGEAGRSGSPQDLENRDYILELLLSRTTAGLSYEQCVGVTYQQLHADGDAAIAAIVDAYHAVAEKCDVVVIVGSDYSELGQAIRPAELSTNARIAVNLGAPLLLTVSGKGRTAGEVADVVKVCLAELDAQHAHTAAVVANRCEPAELDAIRKKLDEALRPSSLRSYVLPDEPLLSAPTVAELQSAVRGTPVSGEESLREREVTGVMVAGMTADHVLERLRDGMAVITPGDRSDVVLAVASAHAAEGFPSLSCIVLNGGFELHPSIAALVAGLRLRLPIVATALGTYDTASAAATARGRVTAASQRKIDTAVELMDGHVDITDLLAQLAIPIPTVTTPQMFIHQLTLQARSDRRHIVLPEGDDDRILRSAGRVLQRRVADLTILGDEAQIRQRAGELGVDLADVTVIDPRASRLRDEFADQYAQLRKAKGVTVEQAREIMRDTTYFGTMMVHNGMVDGMVSGAAHTTAHTVRPAFEIIKTVPDVSTVSSIFLMCLPDRVLAYGDCAIIPNPTPEQLADIAISSARTAAQFGIEPRVAMLSYSTGDSGSGADVDKVRTATQLVRERNPDLPVEGPIQYDAAIEPSVAATKLRDSPVAGRATVLIFPDLNTGNNTYKAVQRSAGALAIGPVLQGLRKPVNDLSRGALVEDIVNTVAITAIQAQGGPDGK

SEQ ID NO: 1833 - protein, 692 aa, Rhodococcus erythropolis PR4
MPEAPAAVSSVYVASPEGDTGKSTIALGVLQMLCATVARVGVFRPIARSTEETDYILELLLEHTTADLSYADALGVTYEQVHADPEAALADIVAKYHTVAEQCDAVVIIGSDYTDVASPSELSFNARIAVNLGAPVLLAVRGARRSVEEVAQLAHLCAAELAANHAHLLAVVANRCDPDKLDEVTAALSDIGVPTWSLPEIPLLVSPTMAELMEATGGELYSGDPELLHREALKVMVGGMTAEHILERLVEGMVVIAPGDRSDVLLALLNAHEAEGFPSLAGIIMNGGITPHPAIAALMAGLKQRLPILTTTLGTFDTASAAAQTRGRVAVGSQRKVDTALSLMEQRVDADVLMDRLALPIPSVVTPQMFEYKLIDRARRDRKHIVLPEGDDDRILRAAGRLLQRQVADLTILGDEPSVRRRAAELGVDISGAQVLAPAQSEYTERFAQEYTALRAHKGMTIERAREVIADISYFGTMMVHLGIADGMVSGAAHTTAHTIRPSFEIIKTAPGVSTVSSIFLMCLADRVLSYGDCAVVPDPTSEQLADIAISSAQTASQFGIDPRIAMLSYSTGDSGSGADVDKVRTATALVRERRPDLLVEGPIQYDAAVEQSVADKKMPDSLVAGKATVFVFPDLNTGNNTYKAVQRSAGAIAVGPVLQGLNKPVNDLSRGALVQDIVNTVAITAIQAQGA

SEQ ID NO: 1834 - protein, 706 aa, Rhodococcus jostii RHA1
MAMAAPATPSPVNPPARSQPSSVYIASPEGDTGKSTIALGVLQMLCASAARVGVFRPIARSTQETDYILELLLEHTTADVGYEEALGVTYEHVHADPDGALSEIVSRYHQVAAQCDAVVVIGSDYTDVASPSELGYNARIAANLGAPVLLAVKGARRTPEEVAQLAHLAIGELTSHHAHPLAVVANRCDPDELDAVTAALASTGVPAWSLPEIPLLVAPTMAELLESIDGSLFSGDPELLHREALRVMVGGMTAEHILERLTEGTVVIAPADRSDVLLAMVNAHEAEGFPSLAGIIMNGGLMPHPAIAKLMAGLKPRLPILTTGLGTFDTASAAAQTRGRVAVGSQRKIDTALSVMELRVDAPTLLERLKLPIPSVVTPQMFEYQLIDRARRDRKHIVLPEGDDDRILRAAGRLLQRQVAALTILGDEVQVRRRAAELGVDLGDAQVLDPRTSDHAGPFAEEYARLRAHKGMTVERAREVMADISYFGTMMVHLGIADGMVSGAAHTTAHTIRPSFEIIKTQPGVSTVSSVFLMCLSDRVLAYGDCAVVPDPTAEQLADIAISSAQTAAQFGIDPRIAMLSYSTGDSGSGADVDKVRSATKLVRERRPDLLVEGPIQYDAAIEQSVADKKMPDSAVAGKATVFIFPDLNTGNNTYKAVQRSAGAIAVGPVLQGLNKPVNDLSRGALVEDIVNTVAITAIQAQGAEK

SEQ ID NO: 1835 - protein, 695 aa, Nocardia farcinica IFM 10152
MVESAPSTVYIASPEGDTGKSTVALGVLQMLCATTARVGVFRPIARSTTEPDYILELLLEHSTADLDYAQSIGVTYEQVHADPDAAISEIVMRFHEVADACDAVVVIGSDYTDVASPSELRFNARIAVNLGAPVLLVVRGSGRTPVEVKQLVELCMSELHAEHAAAVAVIANRCDPDQLDDVCSVLGAFDVPSWALPEVPLLIAPTMAELCEAVGGEMYSGDPELLQREALKIMVGGMTAEHILERLVDGVVVIAPGDRSDVLLSVVNAHEAEGFPSLSGIIMNGGMRPHPAVARLMAGLKPRLPILTTDLGTYDTASAAYRTRGRMSAGNPRKVNTALALMEQHVDAPELLSRIRVRRSDVVTPQMFEYQLIERARADRKRIVLPEGDDDRILRAAGRVLQRKIADLVILGDETAIRARAAELGVDIAEAEVLDPRTSGHLESFAATYTELRKHKGMTLERARETVADISYFGTMMVYEGIADGMVSGAAHTTAHTIRPSFEIIKTVPGVQTVSSVFLMCLADRVLAYGDCAVVPDPTSEQLADIAISSARTAQRFGIDPRVAMLSYSTGESGSGADVEKVRVATDLVRERAPELLVEGPIQYDAAIEPTVADAKLPDSEVAGRATVFVFPDLNTGNNTYKAVQRSAGAIAIGPVLQGLRKPVNDLSRGALVADIVNTVAITAIQAQGIAEQEG

SEQ ID NO: 1836 - protein, 709 aa, Tsukamurella paurometabola DSM 20162
MVASPKTSSIYIASPEGDTGKSTIALGAMNLLTSTGWTIGVFRPIPRTWGEQRDYILELLIEQATADLDYDDCVGVSYEKVHEDPDAAIAEIVSRYHAVADKCDFVLILGSDYTDVSSPTELSFNARIAANLGASILLAVKALDRTPEQVVSVAEQSMAEIRANHAHTSSVIANRCDPGQLDAVRQALATATGLPVWVLPEEPVLTAPTVGELMEAMDGKLLWGDPELLSREAMDVLVAGMTAEHSLERVTEGVAVIAPGDRSEVLLAMVNAHRANGFPSLAGIILNGGYAPHPMTAALVDGLKPTLPIVAVQQGTYESARIAAKTRGRVGPGSARKVDLAVALTERYVVSEDLMEALQVSNPGVVTPQMFEYHLIARARADRKRIVLPEGDDDRILRAAGRLLQREVADLTILGQESRVRARAAELGVDLGDTDVIDPKRATDLIDKFAQTYYELRKHKGMTLERAAETVVDVSYFGTMMVYLGMADGMVSGAAHTTAHTIRPSFEIIKTKPGVSTVSSIFLMCLADKVLAYGDCAVVPDPTETQLADIAISSAQTASQFGIDPRVAMLSYSTGESGTGADVDKVRAATGLVRERAPKLLVEGPIQYDAAVDPGVAASKMPDSAVAGKATVLVFPDLNTGNNTYKAVQRSAGAVAIGPVLQGLNAPINDLSRGALVEDIVNTVAITAIQAQAFAAEKAGKADAKETQA

SEQ ID NO: 1837 - protein, 706 aa, Gordonia bronchialis DSM 43247
MASDTDADTANDTPTLHSIYIASAEGDTGKSTVALGLLALLTATGGRVGVFRPISRAAAGERDYILDLLIEHDSVDIDYDDCIGVTYDQVHEDPEGAIGEIVARFHAVEARCDRVLVIGSDYTDVGNPSELSFNARIAANLSAPIILALKAAGRTPQEVHGLAELLMAEIAASHATTIALVANRCDPDQLVVIEKELEKTGMPTLCLPEEPVLFAPTMAELRDELGAQMYSGDEELLDREALKVMVGGMTVEHILERLTEGTVVITPADRSDVLLALVNANTAQGFPRLSGIILNGGLRPHPMIEALVRGLKPTLPIIACEQGTYETARTAAHTRGRLAKGSARKIEAVLNLVEEHVDPEKVLQKLNVGTPTVVTPQMFEYGLIARARSARKHIVLPEGDEDRVLRAAGRLVRRNVAELTLLGDNDAVRARASELDVDLDGVHIIDPASSEYLDEFASLYTELRKHKGMEFDRAQELMRDVSYFGTMMVHTGRADGMVSGAAHTTAHTIRPAFEIIKTRPGVSTVSSVFFMCLADRVLAYGDCAIVPDPTAEQLADIAISSAQTAGQFDIDPRVAMLSYSTGQSGSGADVDKVRVATDLVRQRAPEVLVEGPIQYDAAVDPSVAATKMPDSEVAGRATVLIFPDLNTGNNTYKAVQRSAGAVAIGPVLQGLNKPINDLSRGALVSDIVNTVAITAIQAQQNTGDAR

SEQ ID NO: 1838 - protein, 699 aa, Jonesia denitrificans DSM 20603
MSSKARSVYISSPEGETGKSTIALGVVDLLSRQVQRVGVFRPITRNGANSRDEVGERDYVLELLLAHDGVDLSYDQCTGATYAEVHHDPEAALANIVARYREMERNCDAVVIVGSDYTDVAGPTELAFNARIAANLGAPVLLVLSGNGRSPEGIRQLFDVSVSELSANYASVMGTIVNRCLTGSIPAVQQVFADVTVPTWTVPEEPFLTAPTVQQLMRAVGGELVNGDDELLGREVLDVLVGAMTFDHLLEKLVDGAVVITPGDRVDVLLGLLVAQTAKSFPSLAGIILNGGFYPPENVSRLLDDINPSVPIIHTSLGTFRTASAAASVRGRLSKEAQRKVDTALALFEQNIDSQAILAALEVQRPEAVTPLMFEYDLLARAREDKKHIVLPEGTDDRILRAASTLLQRQVADLTILGDEPLIRARATELGLDISDAQIINPKSGEMHERFAQEYAQLRAHKGVTVDRAREIVSSVSYFGTMMVQLGLADGMVSGAAHTTAHTIRPAFEIIKTVPDVSVVSSVFFMCLEDRVLVYGDCAVNPDPTAEQLADIAISSAQTAAQFGVSPRIAMLSYSTGDSGTGVDVDKVRAATEIVRERRPDLEVEGPIQYDAAVDASVAASKLPDSAVAGRATVFIFPDLNTGNNTYKAVQRSAGAVAVGPVLQGLRKPVNDLSRGALVQDIVNTVAITAIQAQNQPAS

SEQ ID NO: 1839 - protein, 731 aa, Sanguibacter keddieii DSM 10542
MSSTARSIFITSPEGETGKSTVALGVLDLLTRRVQRVGVFRPVTRTGHTARGTAASAEGSERDYVVELLLAHDGVDLTYEDCVGVTYDDLHADPEAALSQILTKYHEVEKKCDLVVIVGTDYTDVTGPTELAFNARIAANLGAPVLLVLSGRDRSPAGIRQMSEVSVSELQSNHAQVIGVVANRCFPDDLEAIRAEFAGDDLPVWTMPDDPYLMAPTVKQLMGAVGGRLLLGEEELLGREVLDVLVGAMNFEHLLDRLADGAVVITPGDRTDVLLGLLTAQTAKNFPSLAGIILNGGFLPHESVSRLIADLAPSVPIIQTDLGTFRSASAAASARGRVTKDSQRKIDTALALFEQNVDSTSLLASLDVERTGVVTPLMFEYELLNRARADRKHIVLPEGTDDRILRAASTLLQRQVAHLTLLGDEESIRARAVELGLDISEAKVLDPHSGEMHEEFAQAYTTMRAHKGMTVDRAREIVSSVSYFGTMMVQLGYADGMVSGAAHTTAHTIRPAFEIIKTVPNTSVVSSVFLMCLEDRVLVYGDCAVNPDPTAEQLADIAISSAATAAQFGVEPRIAMLSYSTGESGTGADVDKVRAATALVRERRPDLSVEGPIQYDAAVDASVAASKMPDSAVAGRATVFVFPDLNTGNNTYKAVQRSAGAVAVGPVLQGLRMPVNDLSRGALVQDIVNTVAITAIQAQALSAEKARVAGAHAEPAAVPAAGTHGAGAHTA

SEQ ID NO: 1840 - protein, 695 aa, Cellulomonas flavigena DSM 20109
MARTIYVMSAEGDTGKSVVALGLVDLLTRTVQRVGVFRPVARSTEERDYVLELLLEHDGVDIAYEDAVGATYDEVIDDAEAALSRIVSRFHDVERRCDAVVVVGTDYTDVAGPTELAYNARIAANLGAPVVLVVNGARRTPEDVNHAAEVAVNEITANHGQVVSVVANRCAPDALDDVRAALGSELPVWALPDSPLLYAPTLRQLMHAVGGTLTGGDEALLGREVLDVLVGAMSIEHLLDRLQDGAVVITPGDRSDVLLGLLMAHQAEGFPSLAGLILNGGLAPAPTIERLVGGLGSRLPLITTSMGTFRSASAAASTRGRLTYDAARKIDTALALFEQHVDGAELLATLDVERPEVVTPLMFEYALLDRARADRKHVVLPEGNDDRILRAASTLLQRQVADLTILGDEAAIRARATELGLDLDDAQVIDPKNGETLERFAEVYTELRKHKGMTVERAREIVSSVSYFGTLMVQLGLADGMVSGAAHTTAHTIKPAFEIIKTTPGVGSVSSCFLMCLEDRVLVYADCAVIPDPTAEQLADIAISSAETAVQFGIEPRIAMLSYSTGESGSGADVEKVREATRLVRERRPDLSVEGPIQYDAAVDASVAQTKMPDSAVAGRATVFVFPDLNTGNNTYKAVQRSAGAVAIGPVLQGLRKPVNDLSRGALVQDIVNTVAITAIQAQALDAGAVPTPEA

SEQ ID NO: 1841 - protein, 701 aa, Beutenbergia cavernae DSM 12333
MSRNFYVTSPEGHTGKSAIALGLLDLFVRRVSRVGVFRPVIRGGGQRDTVLELLLAHDGVDLTYDECVGVTYDEVHADPDAALDTIVTRFRQVDARCEVVVVVGSDYTDVVGPTELSFNARVAANLGAAVVLVVRALDRTPDDVRQVVDVSVAEIRSRHAAVGAVVVNRSAEADMDDVRAALMSVGPVWVLPDTPLLAAPSVRDLMTALDGSLRSGDEQLLDREAEHIVVGAMGIDHLLDRIVEGSVVITPADRSDAILALMSAHAADGFPTLAAIVLNGGFEPSAQVGRLVEGLGQRLPVVTTQLGTFAAASAAAGVRGLLSTGSQRKIDVARSLFETHVDGDAIVSALDLPATDVVTPLMFEHTLIERARSHRRHIVLPEGGDDRILRAASTLLARGVADLTILGVESAVRSRAAELGLDIEAADVLDPATSDLLEEFAAEYARVRAHKGMTPDRAREIVSDVSYFGTLMVHTKRADGMVSGAQHTTAHTIKPSFEIIKTAPGVDIVSSCFFMCLADRVLVYADCAVNPDPDATQLADIAISSADTAQQFGVSPLIAMLSYSTGESGTGAEVDKVRSATGLVRERAPQLVVEGPIQYDAAVDAGVAASKMPGSAVAGQATVLIFPDLNTGNNTYKAVQRSAGAVAVGPVLQGLAKPVNDLSRGATVKDIVNTVAITAIQAQAAEGAADRGSDESSGGSA

SEQ ID NO: 1842 - protein, 699 aa, Xylanimonas cellulosilytica DSM 15894
MTAKRTIVIASPEGESGKSTIALGVIDLLVRQGQRVGVFRPVSRVSSAEAAHDDGTGRDHVLEMLLEHDGVDLTYEESVGITYDDVHADVDSAMSRIVARYHDVAARCDSVVVLGTDYTDVSGPTELAFNAKIAANLGAPVLLVVSGRGRSDEDTKALTQIGLGELRANHATPIGVMINRYDGTTPPDVAALTADPELPVWVVPEEPFLHAPTVRQLMESVGGELWLGDSELLSREALDVIVGAMSVGHLLDHLSDGCVVITPGDRSDVILSLLAAQSAVSFPSMAGIILTGGMTPEGTIGELVTALAPHVPLIRTAQDTFPAARTAGATVGRVSADATRKVDVARGLFESAVDSEDLLARLAVPSPSVVTPLMFEYELIERARADRRRVVLPEGDDDRVLRAASTVLARGIADLTILGDETSVRARATELGLDISAATVLSPTDPVHVEKYAAEYTRLRAHKGMTVERAREIVTDVSYFGTMMVHVGDAHGMVSGAAHTTAHTIRPSFEIIKTAPGISSVSGVFLMCLEDRVLVYGDCAVIPDPTTEQLADVAIASAATAAQFGVEPRIAMLSYSTGESGSGADVDKVRAATAIVKERRPDLSVEGPIQYDAAVDAAVAASKLPGSDVAGRATVFVFPDLNTGNNTYKAVQRSAGAVAVGPVLQGLNKPVNDLSRGALVQDIINTVAITAIQAQGATE

SEQ ID NO: 1843 - protein, 696 aa, Nocardioides sp. JS614
MCTSVYVASVEGYTGKSAVALGILDVLSRRVERVGVFRPIVRNDQATARGERDYVLDLLTAHEAVTLSYDDCTGVTYDDVHADPVAALDTIVERYHRVAEQCDAVVVIGSDYTDVATPTELSYNARIAANLSSPVLLVLNGADRTPAELVTLADIASTAISASHAALFAVVANRVTHPEPAEVVAALGRDEVPAYAIPYDPLLSAPSVADLMPACNGTVVSGDPALLDREVLGLLVAGMTMPNVLDRLFDGAVVVTAGDRPEVVLGVLMAHVSSNFPQVAGIVLNGGIELPAQVARLLAGIGATLPIIATDLATQETSAALTGVRGRLTVSSPRKIAAALALFAQHVEGDALLDRLDVSPTTAVTPLMFEHQLLDSATSRRMRIVLPEGEEERILRAADLLLRRGVADLTLLGDPIRINAHAARVGADVSAATLLDPRSSELAERFAEEYFDRRKHRGVDRDDALVRVLDESYFGTLMVELGLADGMVSGAVHTTAHTIRPALEVVRTAPGVSVVSSVFFMCLENQVLVYGDCAVNPDPTAEQLADIAISSAETAAAFGVEPRVAMLSYATGSSGAGSDVEKVSAATALVRDRAPELLVEGPIQYDAAIDPAVARTKLPGSPVAGQATVFIFPDLNTGNNTYKAVQRSAGAVAIGPVLQGLRKPVNDLSRGATVRDIVNTVAITAVQAQQLAEVAR

SEQ ID NO: 1844 - protein, 709 aa, Kribbella flavida DSM 17836
MGSSVYVASVEGSTGKSTVALGVLQQLSRRVGRVAVFRPIVRPDTARHGGRDYVLDLLISHDAVDLAYEDCVGVTYDEVHDDPEAALDVIVRRYHDVAERADAVLVVGSDYTDVGTPTEFSYNAKIAANLGTPVLLVLNGFRRSLEDLRAIADLAVAELTANHGALAAVVANRVNPHDLGRTVGALAGVGVPAYALPEEPVLSQPTPADLLEPIAGRMLSGDPELLSREVTGLVVAGMTMPNVLDRLFDGAAVITAADRPEVVLGVLMAHASRTFPQISAIVLNGGFTLPAQVQRLIEGLGVTLPILETDLDTQAASAALTAVRGRLTKDSPRKLDTALALFEQHVDSQALLDQLAVARSSAVTPLMFEHQLIDAAVADRKHIVLPEGEEERILRAADVLLRRGVAELTLLGDPVAISAKAAGLGLDLSAAKVVDPENDPLAEQFALELHRLRQHRGVDLDRARELVKDVSYFGTMMVQLGLADGMVSGSVHTTAHTIRPALEIVKTVPGVSVVSSVFFMCLQHQVLVYGDCAVNPDPTAEQLADIGISSAATAVAFGIEPRVAMLSYSTGTSGTGTDVEKVSAATAIIRDRAPDLLVEGPIQYDAAIDAAVARTKLPGSPVAGRATVFVFPDLNTGNNTYKAVQRSANAVAVGPVLQGLRKPVNDLSRGATVRDIVNTVAITALQAQQAKPAVESSGPATVPVEGGSR

SEQ ID NO: 1845 - protein, 722 aa, marine actinobacterium PHSC20C1
MAQNIYITSIEGHAGKSTVALGLLDTLSREAKRLGVFRPVARTSNERDYVLEMLLAHDAVNLNYDDAVGVGYDDVHADPEAALSRIVERFKAVEAQCDVVVIVGSDYTDVGSPTELSYNARVAANLGAPVLLVLGGQSEDGESRSPDALAQVYAIAHQELDAAHAQLVGVIVNRSDPDHLADVIAGVSAAVGGDTPVWAIPEDPFLIAPSLAALLAAVEGELLKGDSDLLLREALGVVVAGMTMENVLTRLIEGSVVVVAGDRSDVLLATLMAHASETFPSLAGIILNGGFELLPQIERLIDGLDLSLPVIRTSLGTYDTARIITKTRGRLAADSPRKFDTALALFEQNVDAEVLLQRLELNPPTVVTPLMFEYGLLDRARKNPQHIVLPEGGDDRILRASSTLLRRGVAKLTILGDEGEVRGRAAELGLDISAAHVVSPFDENFRSQFATEYVRLRAHKGMTMETARDTVTDVSYFGTMMVHLGLADGMVSGAAHTTAHTIRPSFEIIKTKPDVSIVSSVFLMCLEDRVLVYGDCAVNPDPDAAQLADIAISSAATAEQFGIEQRIAMLSYSTGTSGSGADVDKVRLATTLVSERRPDLAVDGPIQYDAAVDAAVGKSKMPGSEVAGRATVFVFPDLNTGNNTYKAVQRSAGAVAIGPVLQGLRKPINDLSRGALVQDIVNTVAITAIQAQSVAAEAAATAATIVTASAPHHAAPSHGKHS

SEQ ID NO: 1846 - protein, 705 aa, Clavibacter michiganensis subsp. sepedonicus
MARSIYITSAEGHSGKSTVALGVLDTLTHQIQRVGVFRPIARSIVERDYVLEALLSHDGVDLDYDECVGVTYDDVHADPEAALSRIVERYKAVEAKCDAVVIVGSDYTDVGSPTELSFNARIAANLGAPVLLVLTGRRTDETGGRSPDEMRQIADLAIPELVTAHAGLLGVVVNRADPEQLDAITAAIPAAVPASLQAQAPHVPVWAIPEDAFLVAPTVAELLDAVDGTLVKGDAALLSREALGVVVSAMSMENVLARLTEGAIVVIPGDRSEVLLGVLTAHASETFPTVAGIVLNGGFALSPTIERLVSGLDETLPIISTELGTYETAKRITQTRGRLSPESSRKMDTALAAFEQHVDTSRLLELLDVSRSDVVTPLMFEYGLIERARKAGKRIVLPEGTDDRVLRAAGTILSRGIADVTILGEEIEVRSRAIGLGIDIGRATVLSPFDAVLRERFAEEYVRLRAHKGMVLDIARETVTDVSYFGTMMVQLGLADGMVSGAAHTTAHTIRPGFEIIKTTDGVSVVSSVFLMALADRVLVYGDCAVNPDPTADQLADIAISSAGTAAQFGIEPRIAMLSYSTGESGAGADVEKVRQATARVRELRPDLAVEGPIQYDAAADAAVAATKMPGSEVAGRATVFIFPDLNTGNNTYKAVQRSAGAVAIGPVLQGLRKPINDLSRGALVQDIVNTVAITAIQAEGIEAG

SEQ ID NO: 1847 - protein, 709 aa, Leifsonia xyli subsp. xyli str. CTCB07
MARSLYITSAEGHTGKSTVALGVLEALRHSVERVAVFRPIARSTVERDYVLDLLLTRVTAQIGYEEAVGVSYEDVHADADAALGEIVRRFRAVEAKADAVVILGSDYTDVGSPTELGYNARIAANLGAPALLVLGGRVGQGFGERLGQADPRSPEELRQLAELAVAELRAEHAGLLAVVANRADSDRLETIVEAVGEAVAAGAPAQGARPQVWAIPEDPFLVAPSIRSIMEVTAGELLAGDRELLAREALGVVVAGMSMNNVLPRLVEGAVVVVPGDRTEVLLAVLMANASGTFSSVAGIVLNGGFELPEPIERLLAGLRSPLPIVYTWLDTYETVVRITHARGRLAADSQRKYDTALALFERHVDAGALLARLDVTRHEVVTPLMFEYDLIERARAADKHIVLPEGEDDRILRAAATLLARGVARLTILGEPFEVRSRAIEIGLDISGAEVLSPFDDVLRLRFAHEYAELRAHKGITVDQASDTVTDPSYFGTMMVHAGLADGMVSGAANTTAHTIRPAFEIIKTSPSVSVVSSVFLMALADRVLVYGDCAVIPDPTAEQLADIAVSSARTAGQFGIEPRVAMLSYSTGDSGTGADVDKVRTATALVRDRAPQLPVAGPIQYDAAADAAVGAAKMPGSEVAGRATVFVFPDLNTGNNTYKAVQRSAGAVAIGPVLQGLRKPINDLSRGATVDDIVNTVAITAIQAALS

SEQ ID NO: 1848 - protein, 709 aa, Nitrosomonas eutropha C91
MAKSLYLTSAEGRTGKSAVALGLLDALLADIPSVGIFRPLIRSGSQRDRVLELLRERAGGMIPYEVCVGVTYEDAAHDPDAAMVQIVARFKALEAQCDAVIIVGSDFSDVAAPSELAFNARVAAHLDSPVLLVLGGRSSQSGPEILGQSAARTAAELAQLAQLSLQQLQAAHVSLLATLVNRADPDALDHIRSAVAVVLPPMTPVWAIPEEVLLVAPTVASVLEAVEGTLVRGSEELLSREVPGLVIAGMAMEHVLPRLIEGAAIVVAADRAETLLAVVMAHEAVTFPTLAAVVLNGDFALSPDIERLLDGIDSRLPIIRTSLGTFDTAQRIVRARGVLTPDSRRKIDTVLALFREHVDVFDLRSRLRVYTGGVVTPLMFAYELFERAATFQSHIVLPEGSDDRILRAASTLLLRGVVRLTILGQPASVRQRAAELGLDLDRADVIDPAESPLCEQFAEEYTRLRAHKGVKIEEARHRVTDVSYFGTMMVHFGLADGMVSGVAHTTAHTIKPSFEIIRARPGVSVVSSVFFMLLEDRVLVYGDCAVNPNPNAEQLADIAISSAETAAQFGVEPRIAMLSYSTGGSGSGAEVDLVRRATQLVRERQPTLLVDGPIQYDAASDPVIGAAKLPGSPVAGRATVFIFPDLNTGNNTYKAVQRSAGAIAVGPVLQGLNRPVNDLSRGATVEDIVNTVAITAVQAGLARNKKNSV

SEQ ID NO: 1849 - protein, 714 aa, Catenulispora acidiphila DSM 44928
MGREASAAQGLYITATDAASGKTVVALGVAEAMSRRVRRLGVFRPVVPGGGAVDEVVELIRTRYRIDEPYEDCVGTTYDAVHLDPARAVETIVDRYRALAARCEAVVVVGSDYTDAANTAEFGFNATVAANLGLPVLLVVGGMERTPQDVAAVVRVSRQELTRLHATELAVIVNRVEPGQEDAVRREVAAAFGSAIDDATPLVCTIPEVPGLTAPTIRDLVRAADGQLISGDEALLDREASSLVVAAMSLPNVLDRLTEGVAIIAPGDRTAGLVPGLLAAHEAANFPALSGVFLTGGFTLPASVSRLLEGVSSPLPIITSHEDTLPTALHLAAVRGEITVGHPGKVETALGAFARGVDTSVLLNRLNVTRSVAVTPLMFQAQLLERARSQRRRIVLPEGGDDRILRAADIVARRGAADLLVLGEEEKVRARANALGLDLAGVRIVSPTDEVLVEEFAHEYTRLRERKGMTLDKARDIVQDVSYFGTMMVHTGRADGMVSGAVHTTAHTIRPAFEIIRTVPGVSVVSSVFFMLLADRVLVYGDCAVIPDPDAEQLADVAVSSARTAAAFGVQPRVAMLSYSSGESGSGEDVEKVREAAKLAHARDPDLLLEGPIQYDAAADPEVGALKLPGSAVAGRATVFIVPDLNTGNNLYKAVQRSAGAIAVGPVLQGLRKPVNDLSRGALVQDIVNTIVITAVQAQGETGETGKTGEVSGP

SEQ ID NO: 1850 - protein, 697 aa, Nakamurella multipartita DSM 44233
MTGPVSLSPMSRSLYIASPEALSGKSAVALGLVDLLSRRVGRVGVFRPIVNADPQRDSVVELLIAQPGIRQDYDEAVGVTYAQWHADQDAALSRIVDRFGELSAEYDAVVVVGSDYTDVTTGNEWASNARIAANLGSPVVLVVHGRDRTPAVIAATVELARSELVAWHAHPVAAIANRVDPDAVEDVRERLSRAGLVAGALPNIPLLGAPTVADLRDACGATLWRGDEDLLTRESLGFLVAAMTPPNVLRRLRPSMTVIAPGDRSDMLPALILAHQSATFPDLASVVLTGGYEPPASIAKLIDGIRADVPILLTDGGTFETATGLGQVRGRLTADSSVKLEKALQAFAEGVDADAIVDALDLADPTVVTPMMFQYRLIERARADRRHVVLPEGEEERILRAAAILLRLDVADLTLLGDETLIRAKADTLGLDIAKARIVSPTTPELVATFAAEYARLRAHKGITLELATDIVSDVSYFGTMMVHLGMADGMVSGAVHTTAHTIRPSFEIIKTAPGTTVVSSVFLMCLADRVLVYGDCAVNPDPTAEQLAEIAISSAQTAAQFGVDPRVAMLSYSTGSSGSGADVEKVRTATDIVHTKRPDLLVEGPIQYDAAVDPGVAVTKLPDSQVAGRATVLIFPDLNTGNNTYKAVQRSAGAVAIGPVLQGLNKPVNDLSRGALVADIVNTVAITAIQAQGETA

SEQ ID NO: 1851 - protein, 691 aa, Brachybacterium faecium DSM 4810
MYIASPEGMTGKSMVAFGLLEALASRSDRVGVYRPVVKSSRTRDYAVDLLTSHPAVDQSYEDAIGVDHELVLSDPDAAHERILARHRELAERYGVLVVLGSDYDDLANPTELAFNAEVAANMGAPVVVVLSGLDRSPDQLAALAAVSVGEFGGHHALPIAVVVNRAEPDSLEAIRDVVSARVPGPLVAAIPENPVILAPTVQELKDAVGGTLLQGNPEWLDRVAVGTVIAAMSLPNVLSRLTENCTVIAPGDRYDLLPGLVMAQQSGTFPALSSIVLTGGYDVPEEVGRLISGVQQDLPILTTELSTFDTALQVARSRGRLDVGSPQKVDAARRAVAEHLPIPDLLASLEVTRSDVVTPMMFEFELLARARGEKKTIVLPEGEEPRILAAAEAILARGVADLILLGDENTLRARAAQLGHDISEARVVSPHDEEHLERYAAEYARLRAKKGVTLEQAREKVQDVSYFGTMMVQLGEADGMVSGAAHSTAHTIRPSFEIIKTKPGAKIVSSVFLMALEDRVLVYGDCAVNPDPTAEQLADIAVQSAATAQQFGIAPRIAMLSYSTGSSGSGADVDKVREATSLVRADEPGLDVEGPIQYDAAVDASVAKTKLPDSSVAGRATVFVFPDLNTGNNTYKAVQRSAGAIAIGPVLQGLNKPVNDLSRGALVDDIINTVVITAIQAQAEPAAAPSA

SEQ ID NO: 1852 - protein, 684 aa, Actinomyces urogenitalis DSM 15434
MARSIYIASPSAGTGKTTVALGLIASLTKVVAKVGVFRPFVATREQDPVLGLLLSRSGSSASPAACVGVTWDEFRADPEEALTRIVDSYRAMAREHDVVIIDGSDFDDVAGTPELSLNARVAANIGAPVLLVVSGDQSAADVRSSAEVSIAEIAENHARTVAVLANRCQPGTRQEVASAIAEVPGVTTTTLPAVPFLTAPTLREIATALDANLIAGDDALLDREAESLLVGAMDVSHLLERLVEGQVVITPADRSAVLISLAAANAASGFPNLAALVLNGGFEPAPYVLQLLKGLDQPIPVLTTALDTFEAAKVAGAVTGSLAHASDRKIDVAVTTFEQEADLEALLSALEVEPSDVVTPIMFQAELVERARADRRTIVLPEPDDDRILHAADAILRRGISDVVLLGEEETVRTRATELGLDIAAARVVSTSDPELLEKYAAEFARLRAKKGVTLEQAREKVQDVSYFGTMMVHMGDADGMVSGAAHTTAHTIVPSFQIIKTKPGTSIVSSVFLMLLEDRVLVYGDCAVNPEPTAAELADIAISSAETARQFGVEPRVAMLSFSTGTSGKGADVDKVREATEIVRAKAPELAVEGPIQYDAAIDPTVAAKKAPGSAVAGKATVFIFPDLSAGNIGYKAVQRSSGAVAIGPVLQGLNKPVNDLSRGALVEDIINTVAITAVQAQG

SEQ ID NO: 1853 - protein, 695 aa, Kytococcus sedentarius DSM 20547
MVASPEGNTGKSAIALSLVEAAVATVERVGVFRPVAREQDRQSDPILSALLSRAGSSIDPVDAVGATYEDVHADEDEAMARIVSAYHRVAEQSDLVIVLGSDFTDVTGPTEFSFNARVAANLSARLVLVVHGDGRTGEQVRTVVEMCVHEAQAQHASVLGVVCNRVTGVDPDAVTLALEGLVAQDGTAVPVLATIADLPLLSAPTVRDVMGAVDGTQLWGDEAALDREVEDILVGGMNPEHILERLSDGQLCIAASDRVEILLTLIAAHTSDRLPTLSGVVLNGGFELGERVRELVDGLNLRLPVIETAGHTYETARAAASVRGLLGQGSGRKTTAALAHVGARLDARAVLEQLDVRPTTVVTPLMFQHQLVERAAQHRRHIVLPEGSDDRILRAAGRVLTRDLVDLTILGEVGALQRRAQELGVDLSGATLRDPADDPDAERLAELYTDLRRHKGMTLETARTVVTDANHFGTLLVRDGQCDGMVSGAAHTTADTIRPAFQVIGTAEGSNEVSSAFLMCLADRVLVFADCAVIPEPTSEELAGIAVASAATAHAFGIEPRVAMLSYSTGESGSGREVEKVREATDLVREAAPDLPVAGPIQYDAAVEPSVAASKMPDSPVAGRATVLIFPDLNTGNNTYKAVQRMAGALAVGPLLQGLARPVNDLSRGALEDDIVNTILMTAVQAASDDAGSTS

SEQ ID NO: 1854 - protein, 690 aa, Streptomyces flavogriseus ATCC 33331
MTRSVYVTGIDRGDGRQVVDLGVMELLTRQVDRVGVFRPLVHDGPDRLFELLRARYRLSQSAETVFGLDYQEASAVQAEKGTDELVSLLVERFHQVARDYEVVLVLGSDFAATQLPDELALNARLANEFGSSVIAVVGGKDQDAGSVRAETRNAYRAYAGLGCDVLAMIVNRVASEDRADIAERLRTQLPVPCSVLPDDPALSAPTVSQITTALGGTVLLGDDSGLARDALDFVFGGAMLPNLLKALTPGCMVVTPGDRADLVIGSLAAHSAGTPPIAGVLLTLNERPGEEILRLAARLAPGTPVIAVAGGSFPTAGELFALEGKLNAATPRKAETALGLFERHVDTGALLERLSVARSGRVTPMMFEHELLEQARSDRRRVVLPEGTEERVLRAADVLLRRDVCDLTLLGDTDVIRKKAADLGIDLAGTHVVDPQTSELRQGFAERYAALRAHRGVTVELAYDVVSDVNYFGTLMVQEGLADGMVSGSVHSTAATIRPAFEIIKTKPEASIVSSVFFMCLADKVLVYGDCAVNPDPDAEQLADIAVQSAVTASRFGVDPRIAMLSYSTGTSGTGADVDKVREATERVRASRPDLRIEGPIQYDAAVEPSVAATKLPASEVAGRATVLIFPDLNTGNNTYKAVQRSAGAVAVGPVLQGLRKPVNDLSRGALVQDIVNTVAITAIQAQSEA

SEQ ID NO: 1855 - protein, 693 aa, Streptomyces griseus subsp. griseus NBRC 13350
MARSVYVTGIDRGDGRQVVELGVMELLTRQVDRVGVFRPLVHDGPDRLYELLRARYRLSQSPASVYGLDYHEASAVQAEKGTDELVSRLVERFHRVAREYEVVLVLGSDFAATQLPDELALNARLANEFGASVIAVVGGKGQTAESVRAETRNAYRAYAGLGCDVLAMVVNRVAAEDRATIAERLAARLPVPVSVLPDDPALSAPTVAQITAALDGTVLLGDDSGLARDALDFVFGGAMLPNLLNALTPGCLVVTPGDRADLVVGSLAAHSAGTPPIAGVLLTLNERPGEEILTLAARLAPGTPVVSVAGGSFPTAGELFALEGKLNAATPRKAETALGLFERHVDTGALLDRISVARSGRVTPMMFEHELLEQARSDRKRVVLPEGTEERVLRAADVLLRRDVCDLTLLGDVDVIRKKAADLGIDLADTQLIDPHTSELRGAFAERYAELRAHRGVTVELAHDVVADVNYFGTLMVQEGLADGMVSGSVHSTAATIRPAFEIIKTKPDARIVSSVFFMCLADKVLVYGDCAVNPDPNAEQLADIAVQSAVTAARFGVEPRIAMLSYSTGTSGSGADVDKVREATERVRAERPELRVEGPIQYDAAVEPTVAATKLPDSEVAGQATVLIFPDLNTGNNTYKAVQRSAGAVAVGPVLQGLRKPVNDLSRGALVQDIVNTVAITAIQAQGEERPA

SEQ ID NO: 1856 - protein, 694 aa, Streptomyces clavuligerus ATCC 27064
MTRSVYVTGIDRGDGRQVVELGVMELLTRQVDRVGVFRPLVHDGPDRLFELLRARYRLTQDPATVYGMDYQDAAALQAEKGTDELVSRLVDRFHAVARQYEVVLVLGTDFVGTQLPDELALNARLANEFGASVIPVVGGKGQPAESVRAEARNAHRAYEALGAKVLALVVNRVAPEERADIAERLGARLPVPCYVLPDEPALAAPTVAQIMHALGATVLLGDDSGLARDALDFVFGGAMLPKFLTALTPGCLVITPGDRADLVVGALAAHSAGTPPIAGLLLTLDERPSDEILALAARLAPGTPVLSVPSNSFPTAAELFGLEGKLNASTPRKAETALGLFERHVDTGELLARLSVVRSGHVTPMMFEHELLEQARADRRRVVLPEGTEERVLWATDVLVRRDVCDLTLLGDTDQIRKKAADLGIDLTGVQLVDPNTSELRQGFAERYAQLRAHKGVTEELAYDVVADVNYFGTLMVEEGLADGMVSGSVHSTAATIRPAFEIIKTRPGASIVSSVFFMCLADKVLVYGDCAVNPDPNAAQLADIAVQSAATAARFGVDPRIAMLSYSTGTSGSGADVEKVREATELVRQTRPELRIEGPIQYDAAVEPSVAATKLPDSEVAGRATVLIFPDLNTGNNTYKAVQRSAGAVAVGPVLQGLRKPVNDLSRGALVSDIVNTVAITAIQAQPERPASV

SEQ ID NO: 1857 - protein, 699 aa, Streptomyces sviceus ATCC 29083
MTRSVYVTGIDRGDGRQVVELGVMELLTRQVDRVGVFRPLVHHSPDRLFELLRARYRLSQDPATVYGLDYHEASALQAERGTDELVSTLVDRFHVVARDFDVVLVLGTDFADTQLPDELALNARLANEFGASVIPVVGGRAQPAESVLAETRNAYRAYDSLGCDVLAMVTNRVTREDRDKIAERLRGRMPVPCYVVPDEPALAAPTVAQIGQALGAKVILGDDSGLARDALDFVFGGAMLPNFLNALTPGCLVVTPGDRADLVVGSLAAHSAGTPPIAGVLLTLNEVPSDEVLTLAARLAPGTPVLSVPGNSFPTAAELFALEGKLNAATPRKAETALGLFERYADTAELARRVSAPSSDRLTPMMFEHKLLETARSDKRRVVLPEGTEPRVLHAAEVLLRRGVCDLTLLGPVDQIRKKAADLGIDLGGCQLIDPAASELRDTFAEKYAALRAHKGVTVELAYDVVSDVNYFGTLMVQEGLADGMVSGSVHSTAATIRPAFEIIKTKPDADIVSSVFFMCLADKVLVYGDCAVNPDPDAVQLADIAIQSAATAEQFGVEPRIAMLSYSTGTSGSGADVDKVREATELVRQRRPDLKIEGPIQYDAAVEPTVAETKLPGSEVAGQASVLIFPDLNTGNNTYKAVQRSAGAIAVGPVLQGLRKPVNDLSRGALVSDIVNTVAITAIQAQNPTVATEKAAQL

SEQ ID NO: 1858 - protein, 700 aa, Streptomyces griseoflavus Tu4000
MTRSVYVTGIDRGDGRQVVELGVMELLTRQVDRVGVFRPLVHDGPDRLFELLRARYRLTQDPATVYGLDYHEASALQAERGTDELVSTLVERFHRVARDYDVVLVLGTDYADTQLPDELSLNARLANEFGASVIPVVGGRRQTAESVRAETRNAYRAYATLGCDVLAMAVNRVARDDRDEIAERLTNRLPVPCYVFPDEPALSAPTVSQIAHTLGAKVVLGDDSGLARDALDFVFGGAMLPNFLAALTPGCLVVTPGDRADLVVGALAAHSAGTPPIAGVLLTLGEVPDEDILTLSDRLAPGTPVLSVPGNSFPTAEQLFSLEGKLNAATPRKAERALGLFERYADTSDLTKRVSAPSSDRVTPMMFEHKLLEQARSDLRRVVLPEGAEERVLHAAEVLLRRGVCELTLLGDVDLIRKKAADLGVDLGDSRLIDPATSELRDSFAEKYAALRAHRGVTVELAYDVVSDVNYFGTLMVQEGLADGMVSGSVHSTAATIRPAFEIIKTKPDADIVSSVFFMCLADKVLVYGDCAVNPDPDAEQLADIAVQSAVTAARFGVEPRIAMLSYSTGTSGSGADVDKVRTATELVRSRRPDLRIEGPIQYDAAVEPSVAATKLPGSEVAGQATVLIFPDLNTGNNTYKAVQRSAGAIAVGPVLQGLRKPVNDLSRGALVQDIVNTVAITAIQAQSPAPVPSEKAAVQ

SEQ ID NO: 1859 - protein, 700 aa, Streptomyces ghanaensis ATCC 14672
MTRSVYVTGIDRGDGRQVVELGVMELLTRQVDRVGVFRPLVHDGPDRLFELLRARYRLTQDPATVYGMDYPEASALQAERGTDELVSALVDRFHRVARDYDVVLVLGTDYADTQFPDELSLNARLANEFGASVIPVVGGRKQTAESVRAETRNAYRAYDTLGCDVLAMVVNRVAREDRDEIAERLSSRLPVPCYVLPDEPALSAPTVSQIAHTLNAKVVLGDDSGLARDALDFVFGGAMLPNLLAALTPGCLVVTPGDRADLVVGSLAAHSAGTPPIAGVLLTLDEVPGDDILTLAARLAPGTPVLSVSGNSFPTAEQLFSLEGKLNAATPRKAETALGLFERYADTAEIERRVSAPSSDRVTPMMFEHKLLEQARSDLRRVVLPEGAEERVLHAAEVLLRRGVCELTLLGPVDPIRKKAADLGIDLGDTQLIDPATSELRDSFAEKYAALRAHRGVTVELAYDVVSDVNYFGTLMVQEGLADGMVSGSVHSTAATIRPAFEIIKTREDARIVSSVFFMCLADKVLVYGDCAVNPDPDAEQLADIAVQSAVTAARFGVEPRIAMLSYSTGTSGSGADVDKVREATELVRARRPDLKIEGPIQYDAAVEPSVAATKLPDSEVAGQATVLIFPDLNTGNNTYKAVQRSAGAIAVGPVLQGLRKPVNDLSRGALVQDIVNTVAITAIQAQSPASSPSEKAAAP

SEQ ID NO: 1860 - protein, 700 aa, Streptomyces viridochromogenes DSM 40736
MTRSVYVTGIDRGDGRQVVELGVMELLTRQVDRVGVFRPLVHDGPDRLFELLRARYRLAQDPATVYGMDYHEASALQAEAGTDELVSTLVDRFHLVARDYDVVLVLGTDFADTQLPDELSLNARLANEFGASVIPVVGGRKQSVESVLAETRNAYRAYDTLGCDVLAMVTNRVAPEDRDEIAGQLGSRLPVPCYVLPDEPALSAPTVSQISHALGGKVVLGDDSGLARDVLGFVFGGAMLPNFLGALTPGCLVVTPGDRADLVVGSLAAHSAGTPPIAGVLLTLDEVPGDDILTLADRLAPGTPVLSVAGTSFPTAEQLFSLEGKLNAATPRKAERALGLFERYADTAGLARRVSAPSSDRVTPMMFEHKLLEQARSDLRRVVLPEGTEERVLHAAEVLLRRGVCELTLLGPVDRIRKKAADLGIDLGESQLIDPAASDLRDAFAEKYAALRAHRGVTVELAYDVVSDVNYFGTLMVQEGLADGMVSGSVHSTAATIRPAFEIIKTKPDADIVSSVFFMCLADKVLVYGDCAVNPDPNAEQLADIAIQSATTAAQFGVEPRIAMLSYSTGTSGSGADVDKVREATGIVRRLRPDLRIEGPIQYDAAVEPSVAATKLPGSEVAGQASVLIFPDLNTGNNTYKAVQRSAGAIAVGPVLQGLRKPVNDLSRGALVQDIVNTVAITAIQAQSPAPSPSEKATAQ

SEQ ID NO: 1861 - protein, 697 aa, Streptomyces lividans TK24
MTRSVYVTGIDRGDGRQVVELGVMELLTRQVDRVGVFRPLVHDGPDRLFELLRARYRLSQDPATVYGMDYQEASLLQAEQGVDELVSALVDRFHLVARDYDVVLVLGTDYADTQFPDELSLNARLANEFGASVLPVVGGRKQTADSVLAETHNAFRAYDGLGCDVLAMVTNRVAREDRDEIAERLAHRLPVPCWVVPDEPALSAPTVSQIAHALGAEIVLADDSGLARDALDFVFGGAMLPNLLAALTPGCLVITPGDRADLVIGTLAAHSAGTPPIAGVLLTLNEVPGEGILTLAARLAPGTPVLSVTGTSFPTAERLFSLEGKLGAATPRKAETALGLFERYVDTAELNKRVSAPSSDRVTPMMFEHKLLEQARSDLRRVVLPEGTEERVLHAAEVLLRRGVCELTLLGPVEQIRKKAADLGIDLGGAELIDPAASELRDSFAEKYAALRAHKGVTVELAYDVVSDVNYFGTLMVQEGFADGMVSGSVHSTAATIRPAFEIIKTKPDAAIVSSVFFMCLADKVLVYGDCAVNPDPDAEQLADIATQSASTAAQFGVEPRIAMLSYSTGTSGSGADVDKVREATELVRSRRPDLSVEGPIQYDAAVEPSVAATKLPGSAVAGQASVLIFPDLNTGNNTYKAVQRSAGAIAVGPVLQGLRKPVNDLSRGALVQDIVNTVAITAIQAQQSPTEKASAQ

SEQ ID NO: 1862 - protein, 696 aa, Streptomyces avermitilis MA-4680
MTRSVYVTGIDRGDGRQVVELGVMELLTRQVDRVGVFRPLVHDGPDRLFELLRARYRLAQDPATVYGMDYHEASALQAEQGTDELMSTLVDRFHLVARDYDVVLVLGTDFADTQFPDELALNARLANEFGAAVIPVVGGRGQTAESVRAETRNAYRAYEGLGCDVLAMVVNRVAREDREELAARLDSLLAVPCYVLPDEPALSAPTVAQITHALGGKVLLGDDSGLARDALDFVFGGAMLPNFLNALTPGCLVVTPGDRADLVVGALAAHSAGTPPIAGVLLTLDERPSDEVLTLAARLAPGTPVVSVAGTSFPTAAELFSLEGKLNAATPRKAETALGLFERYVDTGDLLKRVSAPSSDRLTPMMFEHKLLEQARSDKRRVVLPEGTETRVLHAAEVLLRRGVCDLTLLGPVDQIRKKAADLGIDLGGSQLIDPVTSQLRDSFAEKYAQLRAHKGVSVELAYDVVADVNYFGTLMVQEGLADGMVSGSVHSTAATIRPAFEIIKTKPDTKIVSSVFFMCLADKVLVYGDCAVNPDPNAEQLCDIAVQSAATARQFGVEPRIAMLSYSTGTSGSGADVDKVREATELVRLRRDDLKIEGPIQYDAAVEPSVAATKLPGSDVAGQASVLIFPDLNTGNNTYKAVQRSAGAIAVGPVMQGLRKPVNDLSRGALVQDIVNTVAITAIQAQSPHEKATAQ

SEQ ID NO: 1863 - protein, 701 aa, Streptomyces scabiei 87.22
MTRSVYVTGIDRGDGRQVVELGVMELLTRQVDRVGVFRPLLHHGPDRLFDLLRARYRLTQDPATVYGMDYHEASTLQAQHGTDELVSALVDRFHAVARDFDVVLVLGTDFADTQFPDELSLNARLANEFGASVIPVVGGRGQTAESVAAETHNAFRAYDGLGCDVLAMVVNRVAPADRDDIAERLGDSRLPLPAPCYVLPDEPALSAPTVAQITHALGGTVLLGDDSGLARDALNFVFGGAMLPNFLNALTPGCLVVTPGDRADLVVGALAAHSAGTPPIAGVLLTLNERPSEEVLTLAARLAPGTPVVAVETGSFLTASELFSMEGKLSAVTPRKAETALGLFEGYVDTAELRSRVSAPSSDRVTPMMFEHTLLEQARSDKRRVVLPEGTEERVLHAAEVLLRRGVCDLTLLGPVEQIRKKAADLGIDLGESQLVDPATSTWRDRFAEKYAQFRAHKNISVELAYDVVSDVNYFGTLMVQEGLADGMVSGSVHSTAATIRPAFEIIKTRPDADIVSSVFFMCLADKVLVYGDCAVNPDPDAEQLADIAVQSAATARQFGVEPRIAMLSYSTGTSGSGADVDKVRRATELVRARRPDLLIEGPIQYDAAVEPSVAATKLPDSEVAGQATVLVFPDLNTGNNTYKAVQRSAGALAVGPVLQGLRKPVNDLSRGALVQDIVTTVAITAIQAQTSAAALGDPGK

SEQ ID NO: 1864 - protein, 691 aa, Streptomyces albus J1074
MARSVYVTGTDRGDGRQVFELGLMELLTRRVDRVGVFRPLVHDGPDRLFEVLRGRYRLSQDPATAHGIDYRRAAGIQAEQGTDALVSQLVDRYLAVARDYEVVLVLGTDYADTQLPDELALNARLANEFGASVLPVVGGRSQSAESVRAEARNAYRAYHALGCDVLALGVNRVAAEDRDVVAQRLGARLPVPCYVLPDDPALSAPTVRQISRALDGTVLLGDDAGLARDVLDFVFGGATLPTFLHALTPGCLVVAPGDRADLVVGALAAHSSGTPPIAGVLLTLGERPDPEVLRLAAKVAPGTPVVSVPGNSFPTATRLFTLEGRLDAATPRKAETALGLFEDWVDTGELLDRISVGSTDRVTPMMFEHKLLERARADRRRVVLPEGLEERVLRAADVLLRRSVCDLTLLGPVDAIRKKAADLGVDLGAAELIDPQESELRKRFAERYAQLRAHKGVSVELAYDVVADVNYFGTLMVEEGLADGMVSGSAHSTAATIRPAFEIIRTRPDATLVSSVFFMCLADRVLVYGDCAVNPDPNAVELADIAVQSALTGARFGVDPKIAMLSYSTGSSGSGADVEKVREATALARERRPDLLIEGPIQYDAAVEPTVAAAKLPGSEVAGQATVLIFPDLNTGNNTYKAVQRSAGAVAVGPVLQGLRKPVNDLSRGALVQDIVTTVAITAVQAQESDA

SEQ ID NO: 1865 - protein, 694 aa, Streptomyces sp. Mg1
MTRSVYVTGIERGDGRQVVELGIMELLTRRTGRVGVYRPLLHDAPDRLFDLLKARYRIDQDAATAYGMDYEEASAIAAEKGTDELVSRLVDRFHRVARDYEVMLVLGTDYADTNLPDELAFNARLANELGAVVVPVVGGTKRPAESVRAEARNAYRAYESLGCHVVAMMVNRVASEDRDAIAERLAARLPVPCYVLPEDKSLSAPTVAEITTALGGEVLLGDDAGLARDALDFVFGGAMLPNFLSALTPGCLVVTPGDRSDLVIGALAAHTSGTPPIAGVLLTLNERPGEDILTLASKLAPGTPVVSVAGNSFPTATELFSLQSRLNSATPRKLETALGLFEGHVDTAELRDLLSVARSERVTPMMFEHELLERARSERRRVVLPEGTEERVLRAADVVLRRGVCDLTLLGETQAILKKAADLGIDISGAQLIDPAASPLRERFAEYYAQARAHKGMTVELAGDVVTDANYFGTLMVQEGLADGMVSGSVHSTAATIRPAFEIIKTKPEASIVSSVFFMCLADKVLVYGDCAVNPDPDAEQLADIAVQSAATAAAFGVEPRIAMLSYSTGTSGSGADVDKVRKATEIVRARHPDLLIEGPIQYDAAVEPSVAATKLPGSEVAGRATVLIFPDLNTGNNTYKAVQRSAGAVAVGPVLQGLRKPVNDLSRGALVQDIVTTVAITAIQAQGAPAPTA

SEQ ID NO: 1866 - protein, 695 aa, Streptomyces sp. C
MTRSVYVTGIERGDGRQVVELGIMELLTRQTGRVGVYRPLLHDGPDRLFDLLRARYRLDQDAATAYGMEYHEASAILAEKGTDELVSRLVDRYHRVARDYEVMLVLGTDYAETNLPDELALNARLANELGAVVVPVLGGAKQPAEAVRAEARNAHRAYESLGCHVVAMVVNRVAPEDRDAIAERLAARLPVPCYVLPDDKNLSAPTVAQITRALGGEVLLGDDAGLARDAVDFVFGGAMLPNFLNALTPGCLVVTPGDRADLVVGALAAHASGTPPIAGVLLTLNERPSADVLTLASKLAPGTPVVSVAGNSFPTAAELFSLQSRLNSATPRKLETALGLFERHVDTAELRGLLSVARSERVTPMMFEHELLERARSERRRVVLPEGTEERVLRAADVVLRRGVCDLTLLGEEQAILKKAGDLGVDISAAQLIDPATSPLRERFAEYYAKARAHKGMTVELAHDVVTDVNYFGTLMVQEGLADGMVSGSVHSTAATIRPAFEIIKTKPEASIVSSVFFMCLADQVLVYGDCAVNPDPDAAQLADIAVQSAATAAAFGVDPRIAMLSYSTGTSGSGADVEKVRKATEAVRAQRPDLLIEGPIQYDAAVEPSVAATKLPGSEVAGRASVLIFPDLNTGNNTYKAVQRSAGAVAVGPVLQGLRKPVNDLSRGALVQDIVTTVAITAIQAQSQSRPQAQ

SEQ ID NO: 1867 - protein, 698 aa, Streptomyces hygroscopicus ATCC 53653
MTRSVYVTGIERGDGRQVVELGVMELLTRHVDRVGVFRPLVHDDPDRLFDLLRARYRLSQPPASASGMSYEEAAALQAEEGSDELVSRLVNRFHEVSREYEYVLVLGSDYADTSLPDELGLNARLANEFGASVITVVGGQDQNAEAVGAEAHNAYRAYEAQGCDVVAVVVNRAVPDDRTEIAERLATRLPVPGYVLPEDGALSAPTVSQIVRTLGADVLLGDHAGLSRDVRDFVFGGAMLPNFLPALTEGCLVVTPGDRADLIVGSLAAHSAGAPAIAGVLLTLDERPGPDILALASRLAPGTPVAAVAGGSFPTAAELFAIEGKLNAGAPRKAETALGLFERHVDTAALTDRIAVARSGRVTPMMFEHELIERSRSGRRRVVLPEGTEERVLRAADVLLRRDVCDLTLLGEEDTIRKRAAELGIQLAEAQIVDPQTSPLRERFAEIYAKLRAHKGVDHELAYDVVADVSYFGTLMVQEGLADGMVSGAVHSTAATIRPAFEIIKTAPGAQIVSSVFFMCLADRVLVYGDCAVNPDPGAEQLADIAIQSATTAARFGVEPRIAMLSYSTGTSGSGADVDKVRKATDLVRERRPDLLVEGPIQYDAAVDAAVAATKLPDSEVAGKATVLIFPDLNTGNNTYKAVQRSAGAVAVGPVLQGLRKPVNDLSRGALVQDIVNTVSITAIQAQSQTPPTTPESR

SEQ ID NO: 1868 - protein, 696 aa, Streptomyces sp. SPB74
MSRSVYVTGTDRGDGRQVVELGVMELLTRRVDRVAVFRPLVHDGPDRMYELFRERYRLSQPPDSVFGMHYAAANALQAERGLNELVSRLVEDYQRLAAEYDAVLVIGTDFAHTQLPDELGLNARLANEFGAFVLPVVGGKEQSAESVRSEAHNAYHAYAGRGCDVLAMIVNRVAPADRDLVQERLTGRIGVPVYVLPDEPSLSAPTVAQITHTLGGTVLLGDEAGLSRDALDFVFGGATLPNFLHALTPGCLVVTPGDRSDLVVGALAAHSASAPAIAGVLLTLGERPDQGILNLAAQLAPGTPLVSVPGNSFPTATELFTLEGRLGAATPRKTETALGLFERWVNGPALLDRIQVAGSGRVTPMMFAHKLIEQARARRRRVVLPEATEERVLRAADVLLRRSVCALTLLGDPAVIRKKAADLGVDLEGAELLDPRDSELRGRFAREYAGLRAHKGVTEELAHDVVADVNYFGTLMVRAGLADGMVSGAVHSTAATIRPAFEVIKTRPDAKLVSSAFFMCLADKVLVYADCAVNPDPDAEQLADIAIQSATTAAAFGVEPRIAMLSYSTGTSGSGADVDKVRQATELVRAERPDLLIEGPIQYDAAVEPSVAATKLPDSPVAGRATVLVFPDLNTGNNTYKAVQRSANAVAIGPVLQGLRKPVNDLSRGALVEDIVNTVAITAIQAGQSGNAEATA

SEQ ID NO: 1869 - protein, 683 aa, Streptosporangium roseum DSM 43021
MRMRSIYVAGLGRGDGRQIVELGLMELLTRHVDRVGVFRPITGEGDDRTLELLNARYRPAASAIGVTAEDAAEIYAQRGNEELIARLVARFHTLERECDALLVLGSSFDTDDLPRELALNARLAAEFGAPVIVVVGAHGEQAAEIAMEMRTGYQVFSDLGSTVLAVIANRVPRGMVVEPELPVPCYVIPEHPSVSAPTVGQVLQAVDAKQIQGDEDGLRRDVLGFVFGGATLPVFLEHLVDGALVITPGDRADLLLVSVAAETAGTARPSGVVLTVGQEPTEAVRALTARLAPGMPVLSATADSFTVATTLGGLEGRLTADNPRKIETAIGHFESHVDTADLADRIELARSDRVTPMMFEHTLLERARADRRHIVLPEGEEDRILRAADILLRRGIVDLTLLGREEVIRRRIGDLGLDLAGVTVVDPLTSPLRDSYAEEYAALRAHKGMTLERAMDVVTDVNFFGTMMLHRGVVDGVVSGAAHTTAATILPAFQIIKTVPGTSIVSSVFFMCLADRVLVYGDCAINPDPDAEQLADIAISSARTAERFGIEPRIAMLSYSTGHSGSGVDVDKVRAATALVMERAPDLLVEGPIQYDAAVDARVADAKLPGSRVAGRATVLIFPDLNTGNNTYKAVQRSAGAVAVGPVLQGLRGPVNDLSRGALVTDIVSTVAITAVQAQEAAR

SEQ ID NO: 1870 - protein, 691 aa, Salinispora tropica CNB-440
MDLVARSVYLTSVSSGGGKSTVALGLAELLSRQVGRIGIFRPLVRGDQPDPILALLSERYRVELPIEDLTGTTYTEATGMVAEGRREQLVSRIVERYRAVERRFPAVVVVGSDFADGGDGAGPRELAFNARLATEFGSVVVPVVDGYEQETATIAAAARGAYHDLADLGATVLAIVANRVTGPLTLPELPVPGYLIPEVPSVSAPTVAEVATALGATQLGGDDTALSRDVLDYVVGAAHVPTLLDHLTEGALVIMPGDRDDLLVATNAAHVAGQVALSGLVLTLGEAPDPRTMRLVERLRPGLAVLSVPSDSYDTVAACNRIEGRLSASNPRKVEAALGAFERCVDTDDLSRRLRVTRSERVTPLMFEYDLIDRARTQRRHVVLPEGSEERILRAAEILLRRGVVELTLLGRPDDVARRTRELGVDIADARVIDPFTSEWRDEFADGYARLRGHRGVTRDLAHDIVPQPNYFGTMMVWAGYADGMVSGATHTTAATIRPAFEIIRNLPDVSIASSVFFMLLADRVLVYGDCAVNPDPDAAQLADIAISSADTAVRFGIEPRVAMLSYSTGSSGTGADVEKVAEATRRVRERRPDLLVEGPIQYDAAIDPAVAATKLPGSTVAGRATVFVFPDLNTGNNTYKAVQRSARAVAVGPVMQGLRRPVNDLSRGATVPDIVNTVAITAIQAGEAGT

SEQ ID NO: 1871 - protein, 689 aa, Salinispora arenicola CNS-205
MAGSVYLTSVGSGGGKSTVALGLAELLSRQVGRIGIFRPLVRGNSPDPILALLSERYRVELPIEDLSGTTYTEATEMVAEGQREQLISRIVERYRAVERRYPAVVVVGSDFADGSDRGAGPRELAFNARLATEFGSVVVPVVDGYEQEPATVTAATRGAYHDLADLGATVLAVVANRVTGPLTLPDLPVPTYLIPEVPSVSAPTVAEVAAALGATQLAGDDAALGRDVLDFVVGAAHVPTLLDHLTEGALVIMPGDRDDLLVATGAAHVAGHVALSGLVLTLGVQPDPRTMRLVERLRPGLAVLSVTSDSYDTVAASNRIEGRPSASNPRKVEAALGAFERCVDTDDLSRRLRVTRSERVTPLMFEYDLIDRARTQRRHVVLPEGNEERILRAAEILLRRDVAELTLLGRPDDVSRRTRELGLDITGAHVIDPFTSEWRDEFADEYARLRAHRGVTVDLAHDIVPQPNYFGTMMVRAGYADGMVSGATHTTAATIRPAFEIIRNLPDVSIASSVFFMLLADRVLVYGDCAVNPDPDAAQLADIAISSADTAVRFGIEPRVAMLSYSTGSSGAGADVEKVAEATRRVRERRPDLLIEGPIQYDAAIDPTVAATKLPGSTVAGRATVFVFPDLNTGNNTYKAVQRSARAVAVGPVMQGLRRPVNDLSRGATVPDIVNTVAITAIQAEEAGE

SEQ ID NO: 1872 - protein, 688 aa, Micromonospora sp. ATCC 39149
MARSVYLTSVGSGGGKSTIALGLAELLSRQVERIGAFRPLVPATGTDPILALLTERYRMDLPTADLSGTTYAQASALVADGRREELISRIVERYRDVERRCPAVVVVGSDFADGGDGTGPRELAFNARLAIEFGSVVVPVVDGIGQGPEAIAAATRGAYHDLVDLGATVLAVIANRVPGPMTLPDLPVPAYAIPEVPTVSAPTVAEVAAALGATLLSGDDAALGRDVLDFVVGAAHVPTLLDHLTEGALVITPGDRADLLVAASAAHVAGQVSVAGLVLTLGEQPDPRAMRLVEGLNTGLAVLSVPSDSYDTVAASSRIEGRPSVAHPRKVEAALGAFESCVDTVDLARRLRVSRSERVTPLMFEYDLIDRARATRRRLVLPEGAEERILRATEILLRRGVAELTLLGRPDDIARRTRELGIDIAGASVVDPAGSPWRDEFAEAYAKLRAHRGMTAELAHDIVAQPNYFGTMMVHTGHADGMVSGATHTTAATIRPAFEIIRTVPGVSVASSVFFMLLADRVLVYGDCAVNPDPDAAQLADIAISSADTAARFGIEPRVAMLSYSTGDSGTGADVEKVAAATRLVRERRPELLVEGPIQYDAAIDPRVAVTKLPDSAVAGRATVFIFPDLNTGNNTYKAVQRSAGAVAVGPVMQGLRRPVNDLSRGATVPDIVSTVAITAVQAAGESS

SEQ ID NO: 1873 - protein, 703 aa, Arthrobacter sp. FB24
MAKGIYVSATTPGSGKSLIALGLADTLHRHADRIGFFKPVVHGPDAASDPMVALMKSRFDLDDDRCRGGLTYAEVRALLAEGNRAEIDARCVEIFAEMSRHCDVVIVEGTDLTGQDAAVEFDLNARLANNLAASIVAVVGAKGRTVEEAADAVEVARKELAAERCSLLAIMVNRADPEDVDGIVAAVKPGASGRPVYVFPELEDIARPTTGEVATALGVGQVAGRQDMERDVHSIKVAAMSVANFLHVLDDGALVIVPGDRADVMVACLASSFSPEFPVPSALILTGGLAPEPNIYSMLAQAPFPVFASPDDTYTTAKRVSEVRSEIWSGHRRKVASALGLWARRVDEAELVERLHLPRLERMTPLRFLHDLIERARLQRRHIVLPEGNDVRILRAAEILHRRDVCDLTILGNESDVRELASTQGIDLSGMTIVDPATSELRRQFAEKYAELRAHKGVDLARALEVMLDGSYFGTMMVQLGVVDGMVSGAAHTTAHTIRPALEFVKTRDGVKIVSSVFLMLMPDRVLVYGDCAVNPDPNAEQLADIALASAETATQFGVEPRVAMLSYSTGGSGTGEAVDKVRQATELVKGRRPDLAVEGPIQYDAAVDAAIAQSKMPGSSVAGQATVFIFPDLNTGNNTYKAVQQSSGAVAVGPVLQGLRKPVNDLSRGCTVEDIVNTVAITAVQAQSVAPVQEPAAAAAHA

SEQ ID NO: 1874 - protein, 692 aa, Arthrobacter oxydans
MAKGIYVSATTPGSGKSLVALGLADTLHRHADRIGFFKPVVHGPDAAADPMVALMKSRFALEDERCRGGLTHEEVRTLLAEGNRAEIDARCVEIFADISRHCDVVIVEGTDLVGQDSAVEFDLNARLANNLAAPIVAVVGAKGRTVAEAAAAVEVARKELAAERCSLLAIMVNRADPADLDAIAAAVKPGASKRPVYILPELEAIARPTTGEVAAALGVRQIAGRPDMERDVKDIKVAAMNVGNFLNVLDEGALVIVPGDRADVMVACLAASFSPEFPVASALILTGGLAPDANIYPLLAQAPFPVFAAREDTYTTARRVSEVRSEIWSGHRRKVASALGLWSRRVDEAELVERLHLPRAERMTPLRFLHDLIERARSQRRHVVLPEGTDVRILRAAEILHRRDVCDLTVLGPESEVRELAAARGIDLSGINIVDPATSDLRQKFAEKYAELRAHKGVDLPKALEIMQDVSYFGTMMVQLGVVDGMVSGAAHTTAHTIRPALEFVKTREGVKIVSSVFLMLMPDRVLVYGDCAVNPDPNVEQLADIALASAETAAQFGVEPRVAMLSYSTGGSGSGEAVDAVRQATELVRQRRPDLAVEGPIQYDAAVDASIAESKMPGSSVAGQATVFIFPDLNTGNNTYKAVQQSSGAVAVGPVLQGLRKPVNDLSRGCTVEDIVNTVAITAIQAQAPAS

SEQ ID NO: 1875 - protein, 691 aa, Micrococcus luteus NCTC 2665
MPQGIFVSTTSTGAGKSLVSLGLADSLYRRSGTVGYFRPVVPGEDVEADPMVLLMREQFGLTAEQARGGLTAAEARTLMAEGRGDEVQQRCVEQYDAMRAACGVVVVEGTDLISPDPAADLDLNAQLARNLGTPVVAVVSGAEMTPEQAADVVDLARRTLDDAGVELLAVMVNRADPRQLDAVGAAVRPGRHAWPVYVLPELPELAHPSVAEVAAALRLEQVAGQETLDRDVTEVKAVSMEGGNFLEVLRDGALVIVSGDRSDAILATVASSLTPDFPTPSGMILTNGILPNRQLQRLYLDAAFPVFATHDDTFTTAAKVSRVRSELSSAQPRKTAAALGAWHQRVDGDELLGRFDLPRSDVVTPLRFLHELITRARADRRQIVLPEGEDARVLRAAEILQRRDVCDLVVLGPESAVKELASREGVDLAGIDLVDPADSPDLERYAQEYARLRAHRGVDLERAREVMQEGAYFGTMMVHLGDADGMVSGAAHTTANTIRPALEFVKTRPGASIVSSVFFMLLPDRALVYGDCAVNPDPDAEQLADIAVASAATAAQFGVDPRVAMLSYSTGASGSGEAVDKVRAATELVRERAPELKVEGPLQYDAAVNASVAASKMPDSEVAGQATVFVFPDLNTGNNTYKAVQQSSGAVAVGPVLQGLNKPVNDLSRGTTVEDIVNTVAITAIQAQDQG

SEQ ID NO: 1876 - protein, 696 aa, Rothia mucilaginosa ATCC 25296
MTTGLYLSAMSQNSGKSLAALGLVDSLIKRADRVGFFRPVFDGATIADDPMARLIREHFGLTEEQVGGAVSMTDALALIAEGDTEEISARAVSAYEKVAANSDVVIVDGVYLPANALSVEFDLNVQIARDLGLPVIAIVGAQEATVEEAVTAVDVARTELLASKADLLAIIVGRAEPELREEIENSVKRGDANLPVYVLPEIPELNAPTVGEVAEALKLDTEGIKAEDLSRDIHGIKVAAMNVSNFLNQFVDGDFVIVPGDRADIVAATLASALAPTFPAPSGVLLTGGLDALPGKNTAVGSLIDNAPFPVLSTTKDTFKSARAVSRVRGALESGHQRKLAAAMGGWDEHVNKDELLARLEIERPASMTPLRFLHNLIETARANRRSVVLPEGYDVRILRASEIIARRDFCDLILLGNPAKIAEICQAEGIELPSTVRIIDIENNEYTEDFAATYAELRAHKGVTIEAARERMTDPSYFGTMLVYKGIADGMVSGAVNTTANTIRPSLEFIKTRPGTKIVSSVFLMLMEDRVLVYGDCAVNPNPNAEQLADIAKASAETARQFGVTPKVAMLSYSTGTSGAGADVDVVREATELVRASNPDFAVEGPIQYDAASNMSIASTKLPGSEVAGQATVFVFPDLNTGNNTYKAVQQSSGAAAVGPVLQGLRKPVNDLSRGTTVEDIINTVAITAIQAQSL

SEQ ID NO: 1877 - protein, 697 aa, Kocuria rhizophila DC2201
MTQGIYISAMTPLSGKTLVALGLTDTMFKRTDALGFFRPVFDGTSPEEDSVLQLMKRTFDLPDSRCRGAVSLERCREILASGEHDDLDSAAMAVYSEMALECDVIVVDGTDLLAHNAVTAEFDLNARLANNMGCSVAAVIGAHESGRVKDVLNAIDVTRTELRQAGCDIYAVIVNRADPEQAEQIRREAKPGNHNLPAYVIPEIPAISNPTVAELVDAQGYGTDFNSASLDRDIKAVKVAAMTAGNFLDQMADGDLVITPGDRTDVVSATLASSLAPTLPVPAGMLLTGGFRPAGAVGSLLGAAPFPVLTTERDTFTTAQAVAGTRGTLAGAHSRKIAAARGAWAEHVDSDELSGRLTLPRPVRRTPLRFLHELVESARADRKRIVLPEGDDPRILRAAELIHRRNFCDLTVLGDPETVRSLAQSEGIELDFDADGLDLVDFQHDDALREKYADEYVRLRSHKGVSKGQALERMMDGSYFGTMMVQMGDVDGMVSGAAHTTANTIRPALEFVKTREGVNIVSSVFFMLLADRVLVYGDCAVNPNPDEQQLADIALASAQTAREFGVDPRVAMLSYSTGGSGSGEDVERVRAATDLVRAADPDFEVEGPIQYDAAVDASIARSKLPGSHVAGQATVFVFPDLNTGNNTYKAVQQSAGAVAVGPVLQGLRKPVNDLSRGCTVDDIVNTVAITAIQAQTL

SEQ ID NO: 1878 - protein, 698 aa, Francisella tularensis subsp. holarctica FSC022
MKKSIFILPTSKHTGLRLLASSMVYALQQKGLKVGSFHPIYDMQMSIKNIQEYLLNNRVKDYVEIVLDKFYQKSQEFDFIIISGLFRQGNNTHKLYPINAIIDELNIEIVKALSSEVIITSYHGNKPLIDINNELDYAMRSLPKQINIIGTIITKLNAPYDDDGRVSFSLTDEDISSEQQQQVTVNMLRELPVFAQKGLNLIGVVEWQQEKTSPRILDIKNILKLNLISRVSLEARVDRVMMCSRGVDNFINDLTPNSLVITSADRSDILVTVCLAAKNGMKIAGILLTAEEYLNDKVKELCVETAEKVGLAILTTRNKSVKTILRIADIDLMGIPLDDKERIQRVKEIICNSLDRDKIISAITADVLGHQVMSPPAFRYHLLKMATKAKKRIILPESYEPRTLQAAKNSHEQGLAECVLIGDRDKIHKVAEMNGFSLPKDIQVVNIDDEAKIKYLNTLMNLRKHKGLSESMARDALKNPIVVATVMLYLGEVDGLVSGAEHTTADVLRPALQLIKTKPNSSLVSSVFFMCMPDQVIVFGDCAVNQDPSAEQLVDIAIQSAESAKKFGIEPRVAMISYSTGTSGSGVQVEKVCTATELLKQKAPELLVDGPLQYDAAMIESVAKSKAPDSPVAGRATVLIFPDLNTGNTVYKAVQRSANVLSIGPVLQGINKPVNDLSRGATVDDITYTIAITAIQAI

SEQ ID NO: 1879 - protein, 698 aa, Francisella philomiragia subsp. philomiragia ATCC 25017
MKKSILILPTSKHTGLRILASSVVYALQQKGLKVDSFHPIYDIDMSIEQIESYLLNNRVKDYVEIVLSKFYEKCLDSDFAVISGLFRQGNNYHRLYPLNAIVDELNIEIIKALGSEVIIVSYHGNKPINDINDELDYAMRSLPKQINIMGAVITKLNAPYDDDGRVSFSLTEEDITYDKQQHVGIDELKELSVFKHKGLVLLGVVEWDKERTSPRILDIKNILKLNHISEVGLDARVDRVMMCSRGVDNFISDLTPNSLIITAADRSDILVTTCLAAKNGMKIAGIILTAEEYLDNKVRELCVETAKKAGLAILTTKNKSVNTILKLASIDLMGIPIDDKERIQKVKEVISSSLDRDTIVRSITSDISEHQVMSPPAFRYHLLKMARKAKKRIILPESYEPRTLQAAKNCHEQGLAECVLIGDREKIFKVAEMNGFSLPESIEVVTVVDEAEAKYLKTLVELRKHKGLSESMARDALKDPIVVATLMLYLGEVDGLVSGAEHTTADVLRPALQLVKTKPNSSLVSSVFFMCMPDEVIVFGDCAVNQDPTAEQLVDIAIQSAESAKKFGIEPRVAMISYSTGSSGSGVQVEKVRKATELLKQSAPDLLVDGPLQYDAAMIESVAKKKAPNSPVAGKATVLIFPDLNTGNTVYKAVQRSANVLSIGPVLQGINKPVNDLSRGATVDDITYTIAITAIQAI

SEQ ID NO: 1880 - protein, 711 aa, Baumannia cicadellinicola str. Hc (Homalodisca coagulata)
MSRTIMLIPIDARVGFTSVSLGLIYAIKQKNMRFSVFQPIAPQSYYGKDNQDVITRIVCNKYHIPYTKPLCINYVESLLAANKQDILMEEIISNYYYNKKEAALILVIGLKPTLQYQFIYTLNYQIAKMLDAEIILVLSLREYLPDKLQQLIKLAFVKLGGNQNITGIIINKLNAPILTYCHANIDMNELFHNSLNTSIHHIDIQSLSKNSPLPVIGAIPWNIDLINIRVSDIASYLKATIINQGNIQARSIKSVTFCTCNLANIIKYFQPDSMLVTSVDRNEVIVAICLAVMNGVEIGALLLTSSSYEIDQHIYQICKKTFQTGLPVFAIQQNILQTMLILQQFRPEIPIDNSRQLENLQNYMASYINHTWIESITTQRTERGMLFSPPAFRYHITELARQANKRIVLPEGDEPRTIKAASLCAKRGIARCVLLGNPSNIQQIAILNSIELGQGIEIIEPIIARDKYVKRLVQLRYHKGMTEDIAYQQLKDNVVLGTLMLEQDEVDGLVSGAMHTTANTIRPPLQLIKTAPGHTLVSSVFFMLLPEQVLVYGDCAININPTAQQLAEIAIQSADSAATLGIEPKVAMISYSTGDSGVGKDVEKVRQATYLAQEKRPDLIIDGPLQYDAAVMAEVALYKAPKSPVAGQATVFIFPDLNTGNTTYKAVQRSAKLISIGPILQGLRKPINDLSRGALVEDIIYTIALTAIQSK

SEQ ID NO: 1881 - protein, 911 aa, Buchnera aphidicola str. APS (Acyrthosiphon pisum)]
GISPPPTABCAIRECNAMEFLLPHSPHATEACETYLTRANSFERASEALTNAMEFLLPHSPHTRANSACETYLASEGIPIREPHSPHATEACETYLTRANSFERASEECIMPRTEDBCHNERASPSTRAINAPSGIDBBABPHSPHATEACETYLTRANSFERASEBCHNERAAPHIDICLASTRAPSACYRTHSIPHNPISMMSRIIMLIPLDKDIGLTSIGLSIIYFFYQKKIKKKSVQSILYFSCTQNSSNSTSHVINKYFSKIVHTVDYIDFSKVLFNSPEYSFLLNKVIDEHYNNKFLRELILIEGIKNNYCINSEEMNYDISQNLNAEVIFIANLENSSPEYIKNKEKKINFFLKQKKYKNILGVIFNQINSPFLENKYDFIKKLIVLKKIKNETKTIVPKKILKNNFFSIIACIPWNRNIVTTRVIDLFNFLNIQHTNLVQKKNHIIEEIIIFDTHHLNLLNKHSLNTLVIVSFSRVDVFLNVLNCNVNRSKVKCIILTGILKLKKNIASLYKFLIKRSISIFFTEKNTIEILSQLQNFNFDISVKDITYIKKLQRYISNFFCHSSFMFFKKKYNINVIYPPKEFCYNLKLLSQKKNKRIKLPESYEIRILKSVAICSDSNIAQCVLLGDPKKIYSIANDNGINLKKNIEIIDPISVRQEYLARFLEIRKGKNINEFSAKKQLEDNTVLATLILESNHVDGLVSGSINTTSDTIRPALQIIKTNPQSLLVSSIFFMLLPNQVLIYGDCAININPTAEELAVIAIQSADSAKMFGIEPRIAMLSYSTGCSGFGCQVEKVKEATSIIKNRRSDLIIDGPIQYDAAVSNKVAKLKAPSSPISGSANVFIFPDLNSGNIAYKAVQRSSRIVSIGPMLQGLRKPVNDLSRGASVEDIIYTIALTSIQSE

SEQ ID NO: 1882 - protein, 703 aa, Verrucomicrobiae bacterium DG1235
MKHVFLTVPTGAKVGLSTVSIGLVRALERQGVRVAFFKPISQPATTEETEDRSTAFIRAVTPLTPPDPIPMAEAKKLLSEDKVELLLENIINRFEDAAKNADVVIVEGLIQTERFPMGGRLNTKLSQTLSSKQILVTNLGKRSLDSLNKELELAVSDFKGRIAGVVINKTDIEAARESIDFDGIGIEPLKEFITVNCPVFKNEELSLIGMVPLDERLLAPRVSDVARLVQAEVLNEGDMANRRVFRIELIARNVPNMLHTLKTGNLLVTPSDRSDIILAASMAANNGARLAGLVLTSDQRPDERIVKLCQSAWKSGLPVLRVGKTSFETARALYDMNLEIAPDDNDRINQAMETVAVNVSSNWIRNTLSSAMKRQLSPPAFRHMLTRNARQKTKRIVLPEGDEPRTMQAAVSCTERGIARCVLLGNPYSIQLKADAMGLTLPSNLEILNPDVIRERYVSSLVEMRRHKNMTEKIARDHLSDNVVLGTMMLAHDEVDGLVSGAVHSSANTVRPAMQLIKTRPGAKIASSIFFMCLPDQVLVYGDCAINPDPNAEELADIAIQSAESAKAFGIEPIVAMISYSTLGSGSGVDVDKVVEATRLVKEARPDIVIDGPLQYDAAAIADVARTKAPDSPVAGKANVFIFPDLNTGNTTYKAVQRSANVISIGPMLQGLRKPVNDLSRGALTDDIIYTIALTAVQAQQND

SEQ ID NO: 1883 - protein, 694 aa, Verrucomicrobium spinosum DSM 4136
MPHTLYLAPSGSSAGLTTIALGLVRSLDIHGVKVAFCKPIGQSTSQDKGPERSTHFVREATHLLPSTPIPLDQAERLITTGRMDELLERVIENYHASAADADVVIVEGLVHTAETPQADELNLQLVKTLSAEVILVGSLGYVPLDEFESRMEYTSRKFGDSVVGCIINRVPDAVDQSLKELGMSFALRSRLFHSSGFHLIGAVPEKAELASCRAVDMARYLNATVLHEGELKTRRVRRFTMLARTVPNMLDTFLPGSVLITPSDRSDVIVATCMATLNDIPIAALLLTGDMEVPPAIFDLCRAGLATGLPILQVPTNSWHTATALTRMSAEVPVDDIERVQQSMDYVASYIDSEWIASHAAIPVEARMSPAAFCFRLTERARQTSRRIILPEGNEPRTIRAAVICAQRGIARCVLIGSPEEIRRVARGQEVELPPQVEILDPVPLRQNYIAPLVEMRKAKGLTPEAAAELLEDNVWLGTVMLALGQVDGLVSGAVHSTANTIRPALQIIKTRPGAKVVSSIFFMCLPDQVLVYGDCAVNPDPDAETLADIAIQSADSAATFGLPVRVAMISYSTGESGSGVDVEKVREATQIARSKRPDLMLDGPLQYDAAAVAEVAASKAPDSPVAGKATVFIFPDLNTGNTTYKAVQRSASVVSIGPMLQGMRRPVNDLSRGALVEDIVYTIALTSIQAGQI

SEQ ID NO: 1884 - protein, 711 aa, Mariprofundus ferrooxydans PV-1
MSHAFLLVSTGAGAGLTTVSLGLVRALDRLGIHTGFCKPIAQLHDGDHGPERSTQLIEHVMNISPPHPISLRRATALLGTDQEGLLMEEVIALYRQSTRHADVVIVEGLVADGHAGYATRLNADVARALDAEVILVGKPEPDLDEYIDIAASAFGDSNGTALIGIILNKVGMTDAGHAVLQADKLQTADADADREGGRLSAEHPDMIGKPFHFIGAIPWQATLISPRMSDVADYMSAKILYSGEIAQRRVERMEVCARTVANTLSVYQPHTLLIFPGDRDDVFIAACMSAMNGVPLAGILLTGGLQPHPRVLALCAQSIETGIPILLVETSSYQTAAQLVQMPAEVAVNDYHLIDRAMDHVANHLDADWLKARCAIERQPRLSPAAFRYQLIQQASEANRRIVLPEGEEPRTVMAAYQCRKRQIAQCILLGNPAKIHQVASSQGIVLDEGITIIDPATVRERYIDPMVVLRQHKGMNRQMAEDQLQARIVLGTMMLAMGEVDGLVAGALHSTANTVRPAFQLIGTSASAKLVSSIFFMCLPDQVVVYGDCAINPDPDAEQLADIAIQSADSARRFGLEPRVAMISYSTGESGAGLEVDKVREATRIVRERRPDLLVDGPLQYDAAAIVSVGQSKAPESRVAGKANVFIFPDLNTGNTTYKAVQRNAHVVSIGPMLQGLCKPVNDLSRGASVEDIVYTIALTAIQAGAADTA

SEQ ID NO: 1885 - protein, 710 aa, Oceanobacter sp. RED65
MQHTFFIAPTEMKTGLTSITLGLMRALDQLGVKVAACKPISREQYDNTHRSIELIAAASGKQPPTPISLPEAQKMMSDKKHDRLMEEVVAMHHKIAKDVDVVIVEGVEPDRNEPYALRLNVEMAKTLDAEVILVAAPNDRDQKALASHVDMAKNLYGGDKNQKLLGIILNKINAPANRSIPIKTQEGPEPTPLSLDELKASYKSLETDHFKLLGLIPWDSDLVAPRTKDIANYLQADVISAANMEDARVKRISLCARTVPNMITALQPGALIVTPGDREDILLAAAMAAQNGMPLAGLLFTSDLDPDERVMGLIAPALAHMPVLKVSTDTFTTATQLASMDDGVKASDPQRMNAIMTHMAEHLDSEYLAARLEVDHHVRLSPAAFRYQLVQLASQANKRIVLPEGDEPRTIQAAAMCQQRGIARCVLLGNPERIQQVAASLGVTLPEDLEILDPEAIRERYIDPMVELRKHKNLTAPMAEAQLEDNVVLGTMMLALDEVDGLVSGAVHTTANTIRPALQIVKTAPDAKLVSSVFFMLLPEQVMVYGDCAVNPDPNASELADIALQSAQSAEAFGIAPKVAMISYSTGSSGSGSDVEKVREATSIAQKNRPDLLIDGPLQYDAATTASVAASKAPDSKVAGQASVVIFPDLNTGNTTYKAVQRSANVVSIGPMLQGLAKPVNDLSRGALVEDIIYTIALTAIQAANQAKAK

SEQ ID NO: 1886 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 1887 - skipped

SEQ ID NO: 1888 - DNA, 15539 bp, artificial sequence
  vector
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 1889 - protein, 788 aa, Lactobacillus pentosus; identical to SEQ ID NO: 482

SEQ ID NO: 1890 - DNA, 2367 bp, Lactobacillus pentosus; identical to SEQ ID NO: 173

SEQ ID NO: 1891 - DNA, 13114 bp, Artificial sequence
  Synthetic construct-pYZ067
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgccgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgacgtcagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacatgtttaaactttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 1892 - DNA, 11856 bp, Artificial sequence
  Synthetic construct-pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 1893 - DNA, 719 bp, Artificial sequence
  UAS(PGK1)-FBA1
aattaccgtcgctcgtgatttgtttgcaaaaagaacaaaactgaaaaaacccagacacgctcgacttcctgtcttcctattgattgcagcttccaatttcgtcacacaacaaggtcctgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 1894 - DNA, 636 bp, Artificial sequence
  Promoter UAS(PGK1)-ENO2
aattaccgtcgctcgtgatttgtttgcaaaaagaacaaaactgaaaaaacccagacacgctcgacttcctgtcttcctattgattgcagcttccaatttcgtcacacaacaaggtcctgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 1895 - DNA, 979 bp, Artificial sequence
  Promoter UAS(FBA1)-PDC1
tgacagcaggattatcgtaatacgtaatagttgaaaatctcaaaaatgtgtgggtcattacgtaaataatgataggaatgggattcttctatttttcctttttccattctcgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 1896 - DNA, 994 bp, Artificial sequence
  UAS(PGK1)-PDC1
aattaccgtcgctcgtgatttgtttgcaaaaagaacaaaactgaaaaaacccagacacgctcgacttcctgtcttcctattgattgcagcttccaatttcgtcacacaacaaggtcctgtcgacccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaa

SEQ ID NO: 1897 - DNA, 731 bp, Artificial sequence
  UAS(PGK1)-OLE1
aattaccgtcgctcgtgatttgtttgcaaaaagaacaaaactgaaaaaacccagacacgctcgacttcctgtcttcctattgattgcagcttccaatttcgtcacacaacaaggtcctgtcgaccggggcgcccgtgcaaaaactaactccgagcccgggcatgtcccgggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaa

SEQ ID NO: 1898 - DNA, 9631 bp, Artificial sequence
  pUC19-URA3::pdc1::GPD-xpk1+ADH1-eutD
gaattcctgcagcccgggggatccttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactatctcgctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagcgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactagatctatccgcggtggagctcggtacccggggatccggcgcgccgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcac

SEQ ID NO: 1899 - DNA, 1115 bp, Artificial sequence
  S. cerevisiae locus with GPD2 deletion
cttagcctctagccatagccatcatgcaagcgtgtatcttctaagattcagtcatcatcattaccgagtttgttttccttcacatgatgaagaaggtttgagtatgctcgaaacaataagacgacgatggctctgccattgttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcagcattgcggattacgtattctaatgttcagataacttcgtatagcatacattatacgaagttatccagtgatgatacaacgagttagccaaggtgacactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattact

SEQ ID NO: 1900 - DNA, 1025 bp, Artificial sequence
  S. cerevisiae locus with FRA2 deletion
gacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatttaaatggcgcgccgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgc

SEQ ID NO: 1901 - DNA, 3388 bp, Artificial sequence
  Modified S. cerevisiae locus on Chromosome XV
actgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactatctcatatacaggcgcgccaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtatacagtaggtgactatctgttggacagattacacgaattaggtatagaagaaatattcggagtaccaggtgactacaatttgcaatttctagatcaaattatttcacacaaagatatgaaatgggtgggaaatgctaatgagttaaatgcctcctatatggccgacgggtacgcaagaacgaaaaaggctgcggcattcttgactacatttggtgttggcgaattatccgcagttaatggcttagcgggctcctatgctgagaacctgcctgttgttgagatcgtgggatctcctacctcgaaagtgcagaacgaaggtaagtttgttcaccatacgttggctgatggtgatttcaagcactttatgaagatgcacgaaccggttactgctgccaggactttattgacagccgagaatgcaactgttgaaattgatagagtgttgtctgccttactaaaggaaagaaagccggtttacatcaatttacctgtagatgtagctgccgctaaggctgaaaaaccatccttgcctcttaagaaggaaaattccacgtcgaatacatctgatcaagagattctgaacaaaatacaggaaagtctgaagaatgccaagaaaccaattgtaatcacaggccatgaaattatatcgttcggcctagagaagactgttactcagtttatttcaaagactaagttacctattactactttgaactttggtaaatcatctgttgatgaagcattgccctcatttttggggatttacaacggtactctgtcagagccaaacttgaaggaatttgtggaatctgctgattttattcttatgttgggtgtaaagcttaccgattctagtacgggtgcatttactcaccatcttaatgaaaataaaatgatttccttgaatatcgatgaaggtaaaattttcaacgaaagaatccaaaatttcgacttcgaatccctgatatcatctcttcttgacttgtccgaaattgaatataaaggcaagtacatagataaaaagcaagaagattttgtaccttctaacgcgctgttgtcacaagatagactgtggcaagctgtcgaaaatttgacccaaagtaatgagacgatcgtggctgaacaaggcacttctttcttcggtgcctcatctatatttctgaaatcgaaatcacattttattggtcaacccttgtggggatctataggatacactttccccgcagctctaggcagccaaattgcagataaagaatctagacatttattgtttatcggagatggatcattgcaactgactgtccaagaattaggactagccattagagagaagataaacccaatctgctttatcattaataacgatggttacacggttgagagggaaattcatggtccgaaccagagttataatgacattcctatgtggaattactcaaaactgccagaaagtttcggggcaacggaagacagagttgtgtccaaaattgtgagaacagaaaatgaattcgtatccgtgatgaaagaagctcaagcagatccaaataggatgtattggatagaacttattctagcaaaggagggtgcacctaaagttttgaaaaagatgggtaagttatttgcagaacaaaacaagagctgataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacggatccacagcctagccttcagttgggctctatcttcatcgtcattcattgcatctactagccccttacctgagcttcaagacgttatatcgcttttatgtatcatgatcttatcttgagatatgaatacataaatatatttactcaagtgtatacgtgcatgcttttttt

SEQ ID NO: 1902 - DNA, 3015 bp, Artificial sequence
  modified S. cerevisiae locus on Chromosome XII
gcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaata

SEQ ID NO: 1903 - DNA, 2900 bp, Artificial sequence
  modified S. cerevisiae locus on Chromosome VII
gttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatggcgcgccccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaa

SEQ ID NO: 1904 - DNA, 2656 bp, Artificial sequence
  modified S. cerevisiae locus on Chromosome XVI
ccaaaaggaatattgggtcagatgaatggacgcgaatgcaagacagaagtccaaatcacgtcaagacaaagaaagaaagaaagaaaaactaacacattaatgtagttttaaaatttcaaatccgaacaacagagcatagggtttcgcaaaggcgcgcctatttgtaatacgtatacgaattccttcaacaaaggccaaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgtttaaacaatggaaggtcgggatgagcatatacaagcactaagaagaacaatacagaactctacacggtattattgtgctacaagctcgagtaaaaccgagtgttttgacgatactaacgttgttaagaaagtaacttgttatcaaactcattaccaacttgtgattaattggtgaataatatgataattgtcgaaattccattgttggtaaagcctataatattatgtatacagattatactagaaattctctcgagaatataagaatccccaaaattgaatcggtatttctacatactaatattaccattacttctcctttcgttttatatgtttcattcctattacattatcgatctttgcatttcagcttccattatatttgatgtctgttttatgtccccacgttacaccgcatgtgacagtatactagtaacatgagtgctaccgaatagatgacattttagactttcattccaacaacttggttgacagaatgttacgta

SEQ ID NO: 1905 - DNA, 451 bp, Artificial sequence
  modified S. cerevisiae locus with YMR226c deletion
gatgatgctatttggtgcagagggtgatgagtaagttctctttatcatctatatattactcttatacactatacgactctactctatgacgtatagcattgatatatattaaggcacgacaccgatttttcttatcggagcgatataaaaagctgaagaaaggaggatagatgaaacagcatggcgcatagaaagtgttcaagctcactagtaaaggcgggaaatagaacattgagaacgtattttgataacctagctaaactaagtaaatctgtatactttttatacatgtaagactttttagctatttcattcttccctgaaccgttttgcgcgattctacggaatataccggcgaaataaaagagataaacttatggatcctcaaatagaggatgaacagatgtgaagaagaaacgagcttaattatatcttcgccatgataactaaa

SEQ ID NO: 1906 - DNA, 1128 bp, Artificial sequence
  modified S. cerevisiae locus with ALD6 deletion
tgatctgatgcgctttgcatatctcatattccttcactagcataaaaatccaaaaaaaaagaatatttaggccgaatggaattattcgtaacgtcatacgaaaaaagtttcaattcgtacaatgcctggcatgttcattcgaatataaggccgccgccttccagtcagggtagccaaaagtataatcccgggtggaaactaaactaaaaaccgtactcacaactttccgcggacgctaacagacaaatagacacactatcaggtcaggaactgccgtcacatacgacactgcccctcacgtaagggcatgatagaattggattatgtaaaaggtgaagataccattgtagaagcaaccagcacgtcgccgtggctgatgaggtctcctcttgcccgggccgcagaaaagaggggcagtggcctgtttttcgacataaatgaggggcatggccagcaccgagacgtcattgttgcatatggcgtatccaagccgaaacggcggtaccgcaagggcgaattcaccttggctaactcgttgtatcatcactggataacttcgtataatgtatgctatacgaagttatctgaacattagaatacgtaatccgcaatgcggatcctctagagtcgacctgcaggcatgctcgagcggccgccagtgtgatggatatctgcagaattcgcccttgccgatcgtgtaccaacctgcatttctttccgtcatatacacaaaatactttcatataaacttacttggtcttacgtcataaataaatatgtatacatataaattaaaaaatttggttttatatttttacaaaaagaatcgtttacttcatttctcccttttaagcgatacaatccatgaaaaaagagaaaaagagagaacaggcttgtgccttctttaaaacatcccacacaaaatcatattgaattgaattttacatcttaagctagtgtacaacaactgctatatccaaagaaaactaacgtggaccgcttttagagttgagaaaaaggtttgaaaaaaatagcaatacaaagacttgtttcatatataaaatacagggagcacattgagctaatataacataaacactgcgaaccaattccaatcaaaaggtacac

SEQ ID NO: 1907 - DNA, 9612 bp, Artificial sequence
  synthetic construct-pLH702
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgatattttcctctggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 1908 - DNA, 7938 bp, Artificial sequence
  synthetic construct-pYZ067DkivDDhADH plasmid
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 1909 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 1910 - protein, 343 aa, Artificial sequence
  Anaerostipes caccae KARI variant K9D3
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 1911 - protein, 343 aa, Artificial sequence
  Anaerostipes caccae KARI variant K9G9
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 1912 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 1913 - DNA, 2073 bp, Saccharomyces cerevisiae
atggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattag

SEQ ID NO: 1914 - protein, 690 aa, Saccharomyces cerevisiae
MEGFNPADIEHASPINSSDSHSSSFVYALPKSASEYVVNHNEGRASASGNPAAVPSPIMTLNLKSTHSLNIDQHVHTSTSPTETIGHIHHVEKLNQNNLIHLDPVPNFEDKSDIKPWLQKIFYPQGIELVIERSDAFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMDNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHSDAANHNNIGVPNNNSHSLNTQHNVSDLGNSLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 1915 - DNA, 1251 bp, Saccharomyces cerevisiae
atgaaagcaaagtcgatgaagagcataatatctgtgccaatatcagtgtctaaaacagggaaaatgaagttaacagcatctcccgataatctagcatctatgatgtctaaagaccaaaataaacttattcatttagacccagttccgtcttttgaggacaggcacgagattaaaccgtggctacagaaaatattctatcctcaaggaatagatatagtcatcgaaagatcagatagtagcaaagttacttttaagtgtaggtcagtacgatcgaaagtagggttgaaccctaaatccaaaggttcctcttcaagatcccatgcatgtccatttagaattagagcagcctactctgtgcggttacagaagtggaacgtggttgttatgaataacatacattcacatgagctgagatttgatttgattactaaaacggatgactataaaaagtttaaggaaaatcttcgtcagaagaacgacgaaaaagccatcaaaacatttgatgaattagaatataaagcaagtctaaacttaccactcgtcacaccaattatttcttgtgactgtgggttaaccaaggaaattgaagctttcaataacatttttctcccactatcaaacccccctttgacgtctaaaaaaaatttgctcaaaacaaataaaaactccgtttctaaaataaaatccagacagatggataattcgaaacctaggccaaggttgaaaacgaagttggatgcggatctacatgataccggatttttagacaatttcaaaacgcggaattcctgtgtaaagatagagaaagaagattctttaacgaacttaaacgaaattgattttacgaacatgttttgcaacgacaatttcatccaaaattacaaccaaggcctgatggaacttttgacagaacctacaccaggtccttcgtcctcttcttgtatacttccttcaacaccaacgaggcccttgtcacaaagcaaaatggatatagccctgtcagaatcaacaacatcttcaccaaattttatggaaacagacgctccttatggagatgagatcattaaagtttccaaagataccaaaagcaacgcaccaactgctgatacagatattgctacgaacttaggcaaagagagaaacgaaaattttggcatgttaaactacaactacgaagcgttgcttcatttcaacgatgagcattttaatgaattaaattctattgacccagccttaatatcaaaatattaa

SEQ ID NO: 1916 - protein, 416 aa, Saccharomyces cerevisiae
MKAKSMKSIISVPISVSKTGKMKLTASPDNLASMMSKDQNKLIHLDPVPSFEDRHEIKPWLQKIFYPQGIDIVIERSDSSKVTFKCRSVRSKVGLNPKSKGSSSRSHACPFRIRAAYSVRLQKWNVVVMNNIHSHELRFDLITKTDDYKKFKENLRQKNDEKAIKTFDELEYKASLNLPLVTPIISCDCGLTKEIEAFNNIFLPLSNPPLTSKKNLLKTNKNSVSKIKSRQMDNSKPRPRLKTKLDADLHDTGFLDNFKTRNSCVKIEKEDSLTNLNEIDFTNMFCNDNFIQNYNQGLMELLTEPTPGPSSSSCILPSTPTRPLSQSKMDIALSESTTSSPNFMETDAPYGDEIIKVSKDTKSNAPTADTDIATNLGKERNENFGMLNYNYEALLHFNDEHFNELNSIDPALISKY

SEQ ID NO: 1917 - DNA, 363 bp, Saccharomyces cerevisiae
atgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatga

SEQ ID NO: 1918 - protein, 120 aa, Saccharomyces cerevisiae
MTGERIEKVKINDEFAKSHFLTTQWRETKRQRHYKMPVTEQGLRERIESAIPQVYHIIVTDLSYGCGQSFDIVVVSDFFQGKSKLMRSRAVNKAVKEELQEIHAFSCKCYTEEEWSKIVV

SEQ ID NO: 1919 - DNA, 858 bp, Saccharomyces cerevisiae
atgtgttcttttcaggttccatctgcattttcttttaactacacctcgtactgttataaacgccaccaagcaagatattacacagcagcaaaactttttcaggaaatgcctgttattgaaattaacgatcaagagcaatttacttacctaactaccactgcggccggcgacaagttaatcgtgctttatttccataccagttgggcagaaccatgcaaagcattaaagcaggtttttgaggccattagtaatgagccttccaattccaacgtctctttcttatccattgatgcggacgaaaactcggaaatttcagaactttttgaaatctcagctgttccatattttatcataattcacaaagggacaatcttaaaagaattatccggcgcggatccaaaggagtatgtgtctttattagaagactgcaagaactcagtcaattccggatcatcacaaactcatactatggaaaatgcaaacgtaaatgaggggagtcataatgatgaagacgatgacgacgaagaagaggaagaagaaactgaggagcaaataaacgctagattgactaaattggtcaatgccgcgccggtaatgttatttatgaaggggagcccctctgaacctaaatgcgggttttcgagacaacttgtgggtatcttgagagaacatcaagtaagatttggcttctttgatatattaagagacgaatctgttagacaaaacttgaaaaagttttctgaatggccaactttccctcaactttatataaatggggagtttcaaggcggtttagacattatcaaggaatccttggaggaagaccctgattttttgcagcatgctctccaatcttaa

SEQ ID NO: 1920 - protein, 285 aa, Saccharomyces cerevisiae
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 1921 - DNA, 969 bp, Saccharomyces cerevisiae
atgtccattgtagcactaaagaacgcagtggtgacccttatacagaaagcgaaaggtagtggtggaacctcagagttgggggggtctgaatcaactcccttgttgaggggtagtaatagcaatagttcaaggcatgataacttatcctcatctagctcggatattatctatggtagaaattcagcgcaggatctagaaaactcaccgatgtcagtagggaaagataataggaatggcgataacggttcggataacgaaaaggcgaacctagggttcttccaatcagtagatcctcgcgtaattagcgatttgattatcgggctaagcgacggtttaaccgtcccctttgctctaacagctggtctatcttcacttggtgatgcgaaattggtcattaccggtggctttgctgagttgatctcaggtgcgatttctatgggccttggtggctatttgggagcgaagagtgaatctgattattatcatgctgaagtaaagaaggagaaaaggaaattttacgataactccaacctaattaacagagaaattgaagacattctgttagagattaaccctaatttctcggacgaaacaatcgtttcgttcatcaaagatttacaaagaacacctgagctaatggttgacttcattatcaggtacggtaggggtctagacgaacctgccgagaatagagaactaatcagtgcagtcactatcggtggcggttatctacttggtgggctagtaccactagtgccatatttttttgtctcagatgtgggcacaggtctcatttattctataatagtcatggttgtaacattattctggtttggttacgtaaagacaaaactatccatgggtagtggcagttcgacttcaaagaaagttacggaaggtgttgaaatggttgttgtgggtggtgtagcagcaggtgcggcttggttctttgttaagttactgggttaa

SEQ ID NO: 1922 - protein, 322 aa, Saccharomyces cerevisiae
MSIVALKNAVVTLIQKAKGSGGTSELGGSESTPLLRGSNSNSSRHDNLSSSSSDIIYGRNSAQDLENSPMSVGKDNRNGDNGSDNEKANLGFFQSVDPRVISDLIIGLSDGLTVPFALTAGLSSLGDAKLVITGGFAELISGAISMGLGGYLGAKSESDYYHAEVKKEKRKFYDNSNLINREIEDILLEINPNFSDETIVSFIKDLQRTPELMVDFIIRYGRGLDEPAENRELISAVTIGGGYLLGGLVPLVPYFFVSDVGTGLIYSIIVMVVTLFWFGYVKTKLSMGSGSSTSKKVTEGVEMVVVGGVAAGAAWFFVKLLG

SEQ ID NO: 1923 - protein, 347 aa, Beijerinkia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA
